United States Patent 12,508,308 (INFLUENZA mRNA VACCINES) - sequence listing, part 13

SEQ ID NO: 49299 - RNA, 1410 nt, Artificial Sequence
  neuraminidase__InfluenzaA__ADG59596
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaggacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49300 - RNA, 1410 nt, Artificial Sequence
  neuraminidase__InfluenzaA__ADG59597
augaauccaaaccaaaagauaauaaccauugguucggucuguaugacaauuggaauggcuaaccuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguag

SEQ ID NO: 49301 - RNA, 1410 nt, Artificial Sequence
  neuraminidase__InfluenzaA__ADG59598
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaaaggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49302 - RNA, 1410 nt, Artificial Sequence; identical to SEQ ID NO: 48417
  neuraminidase__InfluenzaA__ADG59599

SEQ ID NO: 49303 - RNA, 1410 nt, Artificial Sequence
  neuraminidase__InfluenzaA__ADG59601
augaauccaaaucagaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguag

SEQ ID NO: 49304 - RNA, 1410 nt, Artificial Sequence
  neuraminidase__InfluenzaA__ADG59602
augaauccaaaucagaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaaaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguag

SEQ ID NO: 49305 - RNA, 1410 nt, Artificial Sequence; identical to SEQ ID NO: 49304
  neuraminidase__InfluenzaA__ADG59603

SEQ ID NO: 49306 - RNA, 1410 nt, Artificial Sequence
  neuraminidase__InfluenzaA__ADG59604
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagugggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49307 - RNA, 1410 nt, Artificial Sequence; identical to SEQ ID NO: 48286
  neuraminidase__InfluenzaA__ADG59605

SEQ ID NO: 49308 - RNA, 1410 nt, Artificial Sequence; identical to SEQ ID NO: 48455
  neuraminidase__InfluenzaA__ADG59606

SEQ ID NO: 49309 - RNA, 1410 nt, Artificial Sequence
  neuraminidase__InfluenzaA__ADG59607
augaauccaaaucagaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguag

SEQ ID NO: 49310 - RNA, 1410 nt, Artificial Sequence; identical to SEQ ID NO: 49309
  neuraminidase__InfluenzaA__ADG59608

SEQ ID NO: 49311 - RNA, 1410 nt, Artificial Sequence
  neuraminidase__InfluenzaA__ADG59609
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaaccuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguag

SEQ ID NO: 49312 - RNA, 1410 nt, Artificial Sequence
  neuraminidase__InfluenzaA__ADG59610
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaaaauagaaaagggaaagauagucaaaucagucgaaaugaaugcuccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacugugggcuggucuuggccagacggugcugaguugccauuuaccauugacaaguag

SEQ ID NO: 49313 - RNA, 1410 nt, Artificial Sequence
  neuraminidase__InfluenzaA__ADG59611
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagagaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcaguggaauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcugaauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49314 - RNA, 1410 nt, Artificial Sequence
  neuraminidase__InfluenzaA__ADG59612
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaaaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucaaauaggauacauaugcagugggauuuucggagauaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucgugggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49315 - RNA, 1410 nt, Artificial Sequence
  neuraminidase__InfluenzaA__ADG59613
augaauccaaaccaaaagauaauaaccauugguucggucuguaugacaauuggaaugacuaacuuaauauuacaacuuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucggccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauagcuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacagucuggacuagcgggagcagcauauccuuuugugguguaaacagugacacuguggguuggucuuggccagacggugcugaguugccauuuaccauugacaaguaa

SEQ ID NO: 49316 - RNA, 1410 nt, Artificial Sequence; identical to SEQ ID NO: 48417
  neuraminidase__InfluenzaA__ADG59614

SEQ ID NO: 49317 - RNA, 1410 nt, Artificial Sequence; identical to SEQ ID NO: 47242
  neuraminidase__InfluenzaA__ADH01811

SEQ ID NO: 49318 - RNA, 1410 nt, Artificial Sequence; identical to SEQ ID NO: 47242
  neuraminidase__InfluenzaA__ADH01821

SEQ ID NO: 49319 - RNA, 1410 nt, Artificial Sequence; identical to SEQ ID NO: 47242
  neuraminidase__InfluenzaA__ADH01831

SEQ ID NO: 49320 - RNA, 1410 nt, Artificial Sequence; identical to SEQ ID NO: 47242
  neuraminidase__InfluenzaA__ADH01841

SEQ ID NO: 49321 - RNA, 1410 nt, Artificial Sequence; identical to SEQ ID NO: 47242
  neuraminidase__InfluenzaA__ADH01851

SEQ ID NO: 49322 - RNA, 1410 nt, Artificial Sequence; identical to SEQ ID NO: 47242
  neuraminidase__InfluenzaA__ADH01861

SEQ ID NO: 49323 - RNA, 1410 nt, Artificial Sequence; identical to SEQ ID NO: 47242
  neuraminidase__InfluenzaA__ADH01871

SEQ ID NO: 49324 - RNA, 1410 nt, Artificial Sequence; identical to SEQ ID NO: 47242
  neuraminidase__InfluenzaA__ADH01881

SEQ ID NO: 49325 - RNA, 1410 nt, Artificial Sequence; identical to SEQ ID NO: 48036
  neuraminidase__InfluenzaA__ADH01891

SEQ ID NO: 49326 - RNA, 1410 nt, Artificial Sequence; identical to SEQ ID NO: 47242
  neuraminidase__InfluenzaA__ADH01901

SEQ ID NO: 49327 - RNA, 1410 nt, Artificial Sequence; identical to SEQ ID NO: 47242
  neuraminidase__InfluenzaA__ADH01911

SEQ ID NO: 49328 - RNA, 1410 nt, Artificial Sequence
  neuraminidase__InfluenzaA__ADH01921
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuacuauugacaaguaa

SEQ ID NO: 49329 - RNA, 1410 nt, Artificial Sequence; identical to SEQ ID NO: 49099
  neuraminidase__InfluenzaA__ADH01931

SEQ ID NO: 49330 - RNA, 1410 nt, Artificial Sequence
  neuraminidase__InfluenzaA__ADH01941
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcugaacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacugaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49331 - RNA, 1410 nt, Artificial Sequence; identical to SEQ ID NO: 48286
  neuraminidase__InfluenzaA__ADH01951

SEQ ID NO: 49332 - RNA, 1410 nt, Artificial Sequence; identical to SEQ ID NO: 48286
  neuraminidase__InfluenzaA__ADH01961

SEQ ID NO: 49333 - RNA, 1410 nt, Artificial Sequence
  neuraminidase__InfluenzaA__ADH01981
augaauccaaaccaaaagauaauaaccauugguucggccuguaugacaauuggaauggcuaacuuaauauuacaaauuggaaacauaaucucaauauggauuagccacucaauucaacuugggaaucaaaaucagacugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacagcaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaaccuuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaauggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaacccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49334 - RNA, 1410 nt, Artificial Sequence
  neuraminidase__InfluenzaA__ADH01991
augaauccaaaccaaaagauaauaaccauugguucggucuguaugacaauuggaauggcuaacuuaauauuacaaauuggaaacauaauuucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49335 - RNA, 1410 nt, Artificial Sequence; identical to SEQ ID NO: 49199
  neuraminidase__InfluenzaA__ADH02011

SEQ ID NO: 49336 - RNA, 1410 nt, Artificial Sequence
  neuraminidase__InfluenzaA__ADH02021
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucggcuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaaauucucaauaaagcaagauaucguaggaauaaaugaguggucaggauauagcgggaguuuuguucaacauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49337 - RNA, 1410 nt, Artificial Sequence; identical to SEQ ID NO: 47242
  neuraminidase__InfluenzaA__ADI24510

SEQ ID NO: 49338 - RNA, 1410 nt, Artificial Sequence; identical to SEQ ID NO: 48016
  neuraminidase__InfluenzaA__ADI24516

SEQ ID NO: 49339 - RNA, 1410 nt, Artificial Sequence; identical to SEQ ID NO: 47242
  neuraminidase__InfluenzaA__ADI24518

SEQ ID NO: 49340 - RNA, 1410 nt, Artificial Sequence
  neuraminidase__InfluenzaA__ADI24522
augaauccaaaccaaaagauaauaaccauugguucggucuguaugacaauuggaauggcuaacuuaauauuacaaauuggaaacauaaucucaauauggauuagccacucgauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaaaauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagaggacgacccaaagagaacacaaucuggacuagcgggagcagcauauccuuuugugguguaaacagugacacuguggguuggucuuggccagacggugcugaguugccauuuaccauugacaaguaa

SEQ ID NO: 49341 - RNA, 1410 nt, Artificial Sequence
  neuraminidase__InfluenzaA__ADI24524
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauuaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49342 - RNA, 1410 nt, Artificial Sequence; identical to SEQ ID NO: 47242
  neuraminidase__InfluenzaA__ADI24526

SEQ ID NO: 49343 - RNA, 1410 nt, Artificial Sequence
  neuraminidase__InfluenzaA__ADI24528
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaaccuuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49344 - RNA, 1410 nt, Artificial Sequence; identical to SEQ ID NO: 49341
  neuraminidase__InfluenzaA__ADI24530

SEQ ID NO: 49345 - RNA, 1410 nt, Artificial Sequence
  neuraminidase__InfluenzaA__ADI24532
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaguggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauuaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49346 - RNA, 1410 nt, Artificial Sequence; identical to SEQ ID NO: 47242
  neuraminidase__InfluenzaA__ADI24538

SEQ ID NO: 49347 - RNA, 1410 nt, Artificial Sequence; identical to SEQ ID NO: 47242
  neuraminidase__InfluenzaA__ADI24548

SEQ ID NO: 49348 - RNA, 1410 nt, Artificial Sequence
  neuraminidase__InfluenzaA__ADI24556
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaauaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugccaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugaucugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49349 - RNA, 1410 nt, Artificial Sequence; identical to SEQ ID NO: 47242
  neuraminidase__InfluenzaA__ADI24558

SEQ ID NO: 49350 - RNA, 1410 nt, Artificial Sequence; identical to SEQ ID NO: 47242
  neuraminidase__InfluenzaA__ADI24560

SEQ ID NO: 49351 - RNA, 1410 nt, Artificial Sequence; identical to SEQ ID NO: 47242
  neuraminidase__InfluenzaA__ADI24562

SEQ ID NO: 49352 - RNA, 1410 nt, Artificial Sequence; identical to SEQ ID NO: 47242
  neuraminidase__InfluenzaA__ADI24564

SEQ ID NO: 49353 - RNA, 1410 nt, Artificial Sequence; identical to SEQ ID NO: 47242
  neuraminidase__InfluenzaA__ADI24566

SEQ ID NO: 49354 - RNA, 1410 nt, Artificial Sequence
  neuraminidase__InfluenzaA__ADI24568
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacagguaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacuggaacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49355 - RNA, 1410 nt, Artificial Sequence
  neuraminidase__InfluenzaA__ADI24570
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcuggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49356 - RNA, 1410 nt, Artificial Sequence
  neuraminidase__InfluenzaA__ADI24572
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacacuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacugugggcuggucuuggccagacggugcugaguugccauuuaccauugacaaguaa

SEQ ID NO: 49357 - RNA, 1410 nt, Artificial Sequence; identical to SEQ ID NO: 49341
  neuraminidase__InfluenzaA__ADI24574

SEQ ID NO: 49358 - RNA, 1410 nt, Artificial Sequence; identical to SEQ ID NO: 49341
  neuraminidase__InfluenzaA__ADI24576

SEQ ID NO: 49359 - RNA, 1410 nt, Artificial Sequence; identical to SEQ ID NO: 48880
  neuraminidase__InfluenzaA__ADI24580

SEQ ID NO: 49360 - RNA, 1410 nt, Artificial Sequence
  neuraminidase__InfluenzaA__ADI24582
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagguagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49361 - RNA, 1410 nt, Artificial Sequence
  neuraminidase__InfluenzaA__ADI24584
augaauccaaaucaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucccucugcccuguuaauggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaaucucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49362 - RNA, 1410 nt, Artificial Sequence
  neuraminidase__InfluenzaA__ADI24592
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaccaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggaguagcauauccuuuugugguguaaacagugacacuguggguuggucuuggccagacggugcugaguugccauuuaccauugacaaguaa

SEQ ID NO: 49363 - RNA, 1410 nt, Artificial Sequence; identical to SEQ ID NO: 48880
  neuraminidase__InfluenzaA__ADI24598

SEQ ID NO: 49364 - RNA, 1410 nt, Artificial Sequence; identical to SEQ ID NO: 47242
  neuraminidase__InfluenzaA__ADI24604

SEQ ID NO: 49365 - RNA, 1410 nt, Artificial Sequence
  neuraminidase__InfluenzaA__ADI24620
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaccaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccaugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagguagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49366 - RNA, 1410 nt, Artificial Sequence
  neuraminidase__InfluenzaA__ADI24622
augaauccaaaccaaaagauaauaaccauugguucggucuguaugacaauuggaauggcuaacuuaauauuacaaauuggaaacauaaucucaauauggauuagccacucaauucaacuugggaaccaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49367 - RNA, 1410 nt, Artificial Sequence; identical to SEQ ID NO: 48515
  neuraminidase__InfluenzaA__ADI46780

SEQ ID NO: 49368 - RNA, 1410 nt, Artificial Sequence
  neuraminidase__InfluenzaA__ADI46789
augaauccaaaccaaaagauaauaaccauugguucggucuguaugacaauuggaauggcuaacuuaauguuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaaugaacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49369 - RNA, 1410 nt, Artificial Sequence; identical to SEQ ID NO: 47242
  neuraminidase__InfluenzaA__ADI48185

SEQ ID NO: 49370 - RNA, 1410 nt, Artificial Sequence
  neuraminidase__InfluenzaA__ADI48187
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuucugugaaauuggcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49371 - RNA, 1410 nt, Artificial Sequence; identical to SEQ ID NO: 49370
  neuraminidase__InfluenzaA__ADI48189

SEQ ID NO: 49372 - RNA, 1410 nt, Artificial Sequence; identical to SEQ ID NO: 47242
  neuraminidase__InfluenzaA__ADI48191

SEQ ID NO: 49373 - RNA, 1410 nt, Artificial Sequence; identical to SEQ ID NO: 47242
  neuraminidase__InfluenzaA__ADI48193

SEQ ID NO: 49374 - RNA, 1410 nt, Artificial Sequence; identical to SEQ ID NO: 47242
  neuraminidase__InfluenzaA__ADI48195

SEQ ID NO: 49375 - RNA, 1410 nt, Artificial Sequence
  neuraminidase__InfluenzaA__ADI48197
augaauccaaaccaaaagauaauaaccauugguucggucuguaugacaauuggaauggcuaacuuaauauuacaaauuggaaacauaaucucaauauggauuagccacucaauucaauuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49376 - RNA, 1410 nt, Artificial Sequence; identical to SEQ ID NO: 47242
  neuraminidase__InfluenzaA__ADI48199

SEQ ID NO: 49377 - RNA, 1410 nt, Artificial Sequence; identical to SEQ ID NO: 47439
  neuraminidase__InfluenzaA__ADI48201

SEQ ID NO: 49378 - RNA, 1410 nt, Artificial Sequence; identical to SEQ ID NO: 48567
  neuraminidase__InfluenzaA__ADI48203

SEQ ID NO: 49379 - RNA, 1410 nt, Artificial Sequence
  neuraminidase__InfluenzaA__ADI48205
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccacuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49380 - RNA, 1410 nt, Artificial Sequence; identical to SEQ ID NO: 47242
  neuraminidase__InfluenzaA__ADI48207

SEQ ID NO: 49381 - RNA, 1410 nt, Artificial Sequence
  neuraminidase__InfluenzaA__ADI48209
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaauuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49382 - RNA, 1410 nt, Artificial Sequence
  neuraminidase__InfluenzaA__ADI48211
augaauccaaaccaaaagauaauaaccauugguucggucuguaugacaauuggaauggcuaacuuaauauuacaaauuggaaacauaaucucaauauggauuagccacucaauucaacuuggaaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaauuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49383 - RNA, 1410 nt, Artificial Sequence; identical to SEQ ID NO: 47242
  neuraminidase__InfluenzaA__ADI48213

SEQ ID NO: 49384 - RNA, 1410 nt, Artificial Sequence
  neuraminidase__InfluenzaA__ADI48215
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagugucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaauuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49385 - RNA, 1410 nt, Artificial Sequence; identical to SEQ ID NO: 47242
  neuraminidase__InfluenzaA__ADI48217

SEQ ID NO: 49386 - RNA, 1410 nt, Artificial Sequence; identical to SEQ ID NO: 47242
  neuraminidase__InfluenzaA__ADI48219

SEQ ID NO: 49387 - RNA, 1410 nt, Artificial Sequence
  neuraminidase__InfluenzaA__ADI48221
augaauccaaaccaaaagauaauaaccauugguucggucuguaugacaaucggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49388 - RNA, 1410 nt, Artificial Sequence; identical to SEQ ID NO: 47242
  neuraminidase__InfluenzaA__ADI48625

SEQ ID NO: 49389 - RNA, 1410 nt, Artificial Sequence; identical to SEQ ID NO: 47242
  neuraminidase__InfluenzaA__ADI48635

SEQ ID NO: 49390 - RNA, 1410 nt, Artificial Sequence; identical to SEQ ID NO: 47242
  neuraminidase__InfluenzaA__ADI48655

SEQ ID NO: 49391 - RNA, 1410 nt, Artificial Sequence; identical to SEQ ID NO: 47242
  neuraminidase__InfluenzaA__ADI48665

SEQ ID NO: 49392 - RNA, 1410 nt, Artificial Sequence
  neuraminidase__InfluenzaA__ADI48675
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacucaaagagaacacaaucuggacuagcgggagcagcauauccuuuugugguguaaacagugacacuguggguuggucuuggccagacggugcugaguugccauuuaccauugacaaguaa

SEQ ID NO: 49393 - RNA, 1410 nt, Artificial Sequence
  neuraminidase__InfluenzaA__ADI48685
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaauggugcuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucguggccagacggugcugaguugccauuuacuauugacaaguaa

SEQ ID NO: 49394 - RNA, 1410 nt, Artificial Sequence; identical to SEQ ID NO: 47242
  neuraminidase__InfluenzaA__ADI48695

SEQ ID NO: 49395 - RNA, 1410 nt, Artificial Sequence; identical to SEQ ID NO: 47241
  neuraminidase__InfluenzaA__ADI48705

SEQ ID NO: 49396 - RNA, 1410 nt, Artificial Sequence; identical to SEQ ID NO: 47242
  neuraminidase__InfluenzaA__ADI48715

SEQ ID NO: 49397 - RNA, 1410 nt, Artificial Sequence; identical to SEQ ID NO: 47242
  neuraminidase__InfluenzaA__ADI48725

SEQ ID NO: 49398 - RNA, 1410 nt, Artificial Sequence; identical to SEQ ID NO: 47512
  neuraminidase__InfluenzaA__ADI48735

SEQ ID NO: 49399 - RNA, 1410 nt, Artificial Sequence; identical to SEQ ID NO: 47242
  neuraminidase__InfluenzaA__ADI48745

SEQ ID NO: 49400 - RNA, 1410 nt, Artificial Sequence
  neuraminidase__InfluenzaA__ADI48755
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaucagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49401 - RNA, 1410 nt, Artificial Sequence; identical to SEQ ID NO: 47242
  neuraminidase__InfluenzaA__ADI48765

SEQ ID NO: 49402 - RNA, 1410 nt, Artificial Sequence; identical to SEQ ID NO: 47242
  neuraminidase__InfluenzaA__ADI48775

SEQ ID NO: 49403 - RNA, 1410 nt, Artificial Sequence; identical to SEQ ID NO: 47242
  neuraminidase__InfluenzaA__ADI48785

SEQ ID NO: 49404 - RNA, 1410 nt, Artificial Sequence; identical to SEQ ID NO: 47242
  neuraminidase__InfluenzaA__ADI48795

SEQ ID NO: 49405 - RNA, 1410 nt, Artificial Sequence; identical to SEQ ID NO: 47242
  neuraminidase__InfluenzaA__ADI49032

SEQ ID NO: 49406 - RNA, 1410 nt, Artificial Sequence
  neuraminidase__InfluenzaA__ADI49243
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucauguucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaagaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49407 - RNA, 1410 nt, Artificial Sequence; identical to SEQ ID NO: 47242
  neuraminidase__InfluenzaA__ADI49263

SEQ ID NO: 49408 - RNA, 1410 nt, Artificial Sequence; identical to SEQ ID NO: 47439
  neuraminidase__InfluenzaA__ADI49273

SEQ ID NO: 49409 - RNA, 1410 nt, Artificial Sequence; identical to SEQ ID NO: 47242
  neuraminidase__InfluenzaA__ADI49283

SEQ ID NO: 49410 - RNA, 1410 nt, Artificial Sequence; identical to SEQ ID NO: 48995
  neuraminidase__InfluenzaA__ADI49315

SEQ ID NO: 49411 - RNA, 1410 nt, Artificial Sequence; identical to SEQ ID NO: 47242
  neuraminidase__InfluenzaA__ADI49325

SEQ ID NO: 49412 - RNA, 1410 nt, Artificial Sequence; identical to SEQ ID NO: 47242
  neuraminidase__InfluenzaA__ADI49335

SEQ ID NO: 49413 - RNA, 1410 nt, Artificial Sequence
  neuraminidase__InfluenzaA__ADI49345
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaccaaagcgucauuacuuaugaaaacaacacuuggguaaaucagacauauguuaacaucagcaacaccaaccuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugacguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49414 - RNA, 1410 nt, Artificial Sequence; identical to SEQ ID NO: 47242
  neuraminidase__InfluenzaA__ADI49355

SEQ ID NO: 49415 - RNA, 1410 nt, Artificial Sequence; identical to SEQ ID NO: 47242
  neuraminidase__InfluenzaA__ADI49365

SEQ ID NO: 49416 - RNA, 1410 nt, Artificial Sequence; identical to SEQ ID NO: 47242
  neuraminidase__InfluenzaA__ADI49375

SEQ ID NO: 49417 - RNA, 1410 nt, Artificial Sequence; identical to SEQ ID NO: 47242
  neuraminidase__InfluenzaA__ADI49385

SEQ ID NO: 49418 - RNA, 1410 nt, Artificial Sequence
  neuraminidase__InfluenzaA__ADI49395
augaauccaaaccaaaagauaauaaccauugguucggucuguaugacaauuggaauggcuaacuuaauauuacaaauuggaaacaugaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaacugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaauuucucaauaaagcaagauaucguaggaauaaaugaguggucaggauauagcgggaguuuuguucagcauccagaacuaacaggacuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49419 - RNA, 1410 nt, Artificial Sequence
  neuraminidase__InfluenzaA__ADI49720
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggagugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcaucuccuuuugugguguaaacagugacacuguggguuggucuuggccagacggugcugaguugccauuuaccauugacaaguaa

SEQ ID NO: 49420 - RNA, 1410 nt, Artificial Sequence; identical to SEQ ID NO: 47445
  neuraminidase__InfluenzaA__ADI49730

SEQ ID NO: 49421 - RNA, 1410 nt, Artificial Sequence; identical to SEQ ID NO: 47445
  neuraminidase__InfluenzaA__ADI49740

SEQ ID NO: 49422 - RNA, 1410 nt, Artificial Sequence; identical to SEQ ID NO: 47445
  neuraminidase__InfluenzaA__ADI49750

SEQ ID NO: 49423 - RNA, 1410 nt, Artificial Sequence; identical to SEQ ID NO: 47242
  neuraminidase__InfluenzaA__ADI49760

SEQ ID NO: 49424 - RNA, 1410 nt, Artificial Sequence; identical to SEQ ID NO: 47272
  neuraminidase__InfluenzaA__ADI49780

SEQ ID NO: 49425 - RNA, 1410 nt, Artificial Sequence
  neuraminidase__InfluenzaA__ADI49790
augaauccaaaccaaaagauaauaaccauugguucggucuguaugacaauuggaauggcuaacuuaauauuacaaauuggaaacauaaucucaauauggauuagccacucaauucaacuugggaaccaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuuuucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49426 - RNA, 1410 nt, Artificial Sequence; identical to SEQ ID NO: 47242
  neuraminidase__InfluenzaA__ADI49821

SEQ ID NO: 49427 - RNA, 1410 nt, Artificial Sequence; identical to SEQ ID NO: 47253
  neuraminidase__InfluenzaA__ADI50029

SEQ ID NO: 49428 - RNA, 1410 nt, Artificial Sequence
  neuraminidase__InfluenzaA__ADI52830
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccuccccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaagccucauacaagaucuucagaauagaaaagggaaagauagucaaaucagucgaaaugaaugccccuaauuaucacuaugaggaaugcuccuguuauccugauucuagugaaaucacaugugugugcagagauaacuggcauggcucgaaucgaccguggguuucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacuggaacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugaugaguugccauuuaccauugacaaguaa

SEQ ID NO: 49429 - RNA, 1410 nt, Artificial Sequence
  neuraminidase__InfluenzaA__ADI52831
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcguuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcaguauauccuuuugugguguaaacagugacacuguggguuggucuuggccagacggugcugaguugccauuuaccauugacaaguaa

SEQ ID NO: 49430 - RNA, 1410 nt, Artificial Sequence; identical to SEQ ID NO: 49004
  neuraminidase__InfluenzaA__ADI52832

SEQ ID NO: 49431 - RNA, 1410 nt, Artificial Sequence
  neuraminidase__InfluenzaA__ADI52833
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaagcucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcaguauauccuuuugugguguaaacagugacacuguggguuggucuuggccagacggugcugaguugccauuuaccauugacaaguaa

SEQ ID NO: 49432 - RNA, 1413 nt, Artificial Sequence
  neuraminidase__InfluenzaA__ADI75821
augaacccaaaucaaaagauaauaaccauuggaucaaucaguauagcaaucggaauaauuagucuaauguuacaaauaggaaauauuauuucaauaugggcuagucacucaauccaaacuggaagucaaaacaacacuggaauaugcaaccaaagaaucaucacauaugaaaacagcaccugggugaaccacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuugaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacugggaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 49433 - RNA, 1410 nt, Artificial Sequence
  neuraminidase__InfluenzaA__ADI75832
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauauagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcgucuguaucaauggaacuuguacaguaguaaugacugaugggagugcuucaggaaaagcugauacuaaaauacuauucauugaggaggggaaaaucguucauaccagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcuggucaaaccauaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 49434 - RNA, 1413 nt, Artificial Sequence
  neuraminidase__InfluenzaA__ADI75854
augaacccaaaucaaaagauaauaaccauuggaucaaucaguauagcaaucggaauaauuagucuaauguugcaaauaggaaguauuauuucaauaugggcuagucacucaauccaaacuggaagucaaaacaauacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguagauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaauugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 49435 - RNA, 1410 nt, Artificial Sequence
  neuraminidase__InfluenzaA__ADI75876
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagagagaaacauaacagagauaguguaucugaccaacaccaccauagagaaggaaguaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcgucuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcguuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaaccauaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 49436 - RNA, 1410 nt, Artificial Sequence
  neuraminidase__InfluenzaA__ADI75887
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcgucuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaaccauaaguccaaauugcagauaaauaggcaagucauaguugacagggguaauagauccgguuauucugguauuuucucuguugaaggcaaaagcugcaucaaucggugcuuuuauguggaguugauuaggggaagaaaagaggagacugaagucuuguggaccucaaacaguauuguuguguuuuguggcaccucagguacauauggaacaggcucauggccugauggggcggaccucaaucucaugccuauauaa

SEQ ID NO: 49437 - RNA, 1413 nt, Artificial Sequence
  neuraminidase__InfluenzaA__ADI75909
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacuuauguuaauauuaacaacacuaauguuguugcuggagaggacaaaacaucagugacauuggccggcaacucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaagcccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 49438 - RNA, 1410 nt, Artificial Sequence
  neuraminidase__InfluenzaA__ADI75920
augaauccaaaucaaaagauaauaacgauuggcucuguuucucucaccauuuccacaauaugcuucuucaugcaaauugccaucuugguaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcacucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaauccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcgaacaucaaucucaugccuauauaa

SEQ ID NO: 49439 - RNA, 1413 nt, Artificial Sequence
  neuraminidase__InfluenzaA__ADI77352
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggcgaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccaguaacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 49440 - RNA, 1410 nt, Artificial Sequence; identical to SEQ ID NO: 47242
  neuraminidase__InfluenzaA__ADI77363

SEQ ID NO: 49441 - RNA, 1410 nt, Artificial Sequence; identical to SEQ ID NO: 48419
  neuraminidase__InfluenzaA__ADI99500

SEQ ID NO: 49442 - RNA, 1410 nt, Artificial Sequence
  neuraminidase__InfluenzaA__ADI99553
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucaguggauuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguauuaaaauacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49443 - RNA, 1410 nt, Artificial Sequence
  neuraminidase__InfluenzaA__ADI99563
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaagugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49444 - RNA, 1410 nt, Artificial Sequence; identical to SEQ ID NO: 49443
  neuraminidase__InfluenzaA__ADI99573

SEQ ID NO: 49445 - RNA, 1410 nt, Artificial Sequence; identical to SEQ ID NO: 49443
  neuraminidase__InfluenzaA__ADI99583

SEQ ID NO: 49446 - RNA, 1410 nt, Artificial Sequence
  neuraminidase__InfluenzaA__ADI99593
augaauccaaaccaaaagauaauaaucauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaauuagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49447 - RNA, 1410 nt, Artificial Sequence
  neuraminidase__InfluenzaA__ADI99613
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcaucauauccuuuugugguguaaacagugacacuguggguuggucuuggccagacggugcugaguugccauuuaccauugacaaguaa

SEQ ID NO: 49448 - RNA, 1410 nt, Artificial Sequence
  neuraminidase__InfluenzaA__ADI99623
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccaugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuaaugaaaucacaugugugugcagggauaacuggcauggcucgaaucgaccgugggugucuuuuaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauuaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49449 - RNA, 1410 nt, Artificial Sequence
  neuraminidase__InfluenzaA__ADI99633
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuucgagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49450 - RNA, 1410 nt, Artificial Sequence; identical to SEQ ID NO: 48668
  neuraminidase__InfluenzaA__ADI99643

SEQ ID NO: 49451 - RNA, 1410 nt, Artificial Sequence
  neuraminidase__InfluenzaA__ADI99653
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaagaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49452 - RNA, 1410 nt, Artificial Sequence
  neuraminidase__InfluenzaA__ADI99663
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccugucaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcaguauauccuuuugugguguaaacagugacacuguggguuggucuuggccagacggugcugaguugccauuuaccauugacaaguaa

SEQ ID NO: 49453 - RNA, 1410 nt, Artificial Sequence; identical to SEQ ID NO: 47242
  neuraminidase__InfluenzaA__ADI99673

SEQ ID NO: 49454 - RNA, 1410 nt, Artificial Sequence; identical to SEQ ID NO: 49451
  neuraminidase__InfluenzaA__ADI99683

SEQ ID NO: 49455 - RNA, 1410 nt, Artificial Sequence
  neuraminidase__InfluenzaA__ADI99703
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcucuuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49456 - RNA, 1410 nt, Artificial Sequence; identical to SEQ ID NO: 47439
  neuraminidase__InfluenzaA__ADI99713

SEQ ID NO: 49457 - RNA, 1410 nt, Artificial Sequence; identical to SEQ ID NO: 47306
  neuraminidase__InfluenzaA__ADI99723

SEQ ID NO: 49458 - RNA, 1410 nt, Artificial Sequence; identical to SEQ ID NO: 47298
  neuraminidase__InfluenzaA__ADI99733

SEQ ID NO: 49459 - RNA, 1410 nt, Artificial Sequence
  neuraminidase__InfluenzaA__ADJ00487
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggacccaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49460 - RNA, 1410 nt, Artificial Sequence; identical to SEQ ID NO: 49459
  neuraminidase__InfluenzaA__ADJ00488

SEQ ID NO: 49461 - RNA, 1410 nt, Artificial Sequence; identical to SEQ ID NO: 49459
  neuraminidase__InfluenzaA__ADJ00489

SEQ ID NO: 49462 - RNA, 1410 nt, Artificial Sequence; identical to SEQ ID NO: 49459
  neuraminidase__InfluenzaA__ADJ00490

SEQ ID NO: 49463 - RNA, 1410 nt, Artificial Sequence; identical to SEQ ID NO: 49459
  neuraminidase__InfluenzaA__ADJ00491

SEQ ID NO: 49464 - RNA, 1410 nt, Artificial Sequence
  neuraminidase__InfluenzaA__ADJ18160
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcauaaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaauaa

SEQ ID NO: 49465 - RNA, 1410 nt, Artificial Sequence
  neuraminidase__InfluenzaA__ADJ18161
augaauccaaaccaaaagauaauaaccauugguucggucuguaugacaauuggaauggcuaacuuaauauuacaaauuggaaauauaaucucaauauggauuagccacucaauucaacuugggaaucaaaaucagauugaaacaugcaaucaaagcgucauuacuuaugaaaacaacacuuggguaaaucagacguauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaauaa

SEQ ID NO: 49466 - RNA, 1410 nt, Artificial Sequence
  neuraminidase__InfluenzaA__ADJ18162
augauuccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaaggaaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaauaa

SEQ ID NO: 49467 - RNA, 1410 nt, Artificial Sequence
  neuraminidase__InfluenzaA__ADJ18164
augaauccaaaacaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcucuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaauaa

SEQ ID NO: 49468 - RNA, 1410 nt, Artificial Sequence; identical to SEQ ID NO: 48846
  neuraminidase__InfluenzaA__ADJ18166

SEQ ID NO: 49469 - RNA, 1410 nt, Artificial Sequence
  neuraminidase__InfluenzaA__ADJ18168
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaauaa

SEQ ID NO: 49470 - RNA, 1410 nt, Artificial Sequence
  neuraminidase__InfluenzaA__ADJ18170
augaauccaaaccaaaagauaauaaccauugguucggucuguaugacaauuggaauggcuaacuuaauauuacaaauuggaaauauaaucucaauauggauuagccacucaauucaacuugggaaucaaaaucagauugaaacaugcaaucaaagcgucauuacuuaugaaaacaacacuuggguaaaucagacguauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugagaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49471 - RNA, 1410 nt, Artificial Sequence
  neuraminidase__InfluenzaA__ADJ18172
augaauccaaaccaaaagauaauaaccauugguucggucuguaugacaauuggaauggcuaacuuaauauuacgaauuggaaacauaaucucaauauggauuagccacucaauucaacuugggaaucaaaaucagauugaaacaugcaaucaaagcgucauaacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacagaaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaauggcucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaauaa

SEQ ID NO: 49472 - RNA, 1410 nt, Artificial Sequence
  neuraminidase__InfluenzaA__ADJ18174
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacuuauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaauacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49473 - RNA, 1410 nt, Artificial Sequence
  neuraminidase__InfluenzaA__ADJ18176
augaauccaaaccaaaagauaauaaccauugguucggucuguaugacaauuggaauggcuaacuuaauauuacaaauuggaaacauaaucucaauauggauuagccucucaauucaacuugggaaucaaaaucagauugaaacaugcaaucaaagcgucauuacuuaugaaaacaacacuugggugaaucagacauauguuaacaucagcaacaccaacuuugcugcuggacagucagugguuuccgugaaauuagcgggcaauuccucucucugcccuguuaguggaugggcuauauacaguaaagacaauaguauaagaaucgguuccaagggggauguguuugucauaagggaaccauucauaucaugcucccccuuggaaugcagaaccuucuucuugacucaaggggccuugcuuaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacuauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49474 - RNA, 1410 nt, Artificial Sequence; identical to SEQ ID NO: 47015
  neuraminidase__InfluenzaA__ADJ37250

SEQ ID NO: 49475 - RNA, 1410 nt, Artificial Sequence
  neuraminidase__InfluenzaA__ADJ37252
augaauccaaaucaaaagauaauaacgauuggcucuguuucucucaccauuuccacaauaugcuucuucaugcaaauugccaucuugguaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacauaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcgaacaucaaucucaugccuauauaa

SEQ ID NO: 49476 - RNA, 1410 nt, Artificial Sequence; identical to SEQ ID NO: 47242
  neuraminidase__InfluenzaA__ADJ37263

SEQ ID NO: 49477 - RNA, 1410 nt, Artificial Sequence; identical to SEQ ID NO: 47232
  neuraminidase__InfluenzaA__ADJ37273

SEQ ID NO: 49478 - RNA, 1410 nt, Artificial Sequence
  neuraminidase__InfluenzaA__ADJ40447
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguaaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49479 - RNA, 1410 nt, Artificial Sequence; identical to SEQ ID NO: 47439
  neuraminidase__InfluenzaA__ADJ40457

SEQ ID NO: 49480 - RNA, 1410 nt, Artificial Sequence; identical to SEQ ID NO: 48668
  neuraminidase__InfluenzaA__ADJ40467

SEQ ID NO: 49481 - RNA, 1410 nt, Artificial Sequence
  neuraminidase__InfluenzaA__ADJ40477
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuauggguuggucuuggccagacggugcugaguugccauuuaccauugacaaguag

SEQ ID NO: 49482 - RNA, 1410 nt, Artificial Sequence
  neuraminidase__InfluenzaA__ADJ40487
augaauccaaaccaaaagauaauaaccauugguucggucugcaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugggucuugcuuuacuguaaugaccgauggaccaagugauggacaggccucauacaagaucuucagaauagaaaagggaaagauagucaaaucaguugaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49483 - RNA, 1410 nt, Artificial Sequence; identical to SEQ ID NO: 48801
  neuraminidase__InfluenzaA__ADJ40507

SEQ ID NO: 49484 - RNA, 1410 nt, Artificial Sequence; identical to SEQ ID NO: 47439
  neuraminidase__InfluenzaA__ADJ40517

SEQ ID NO: 49485 - RNA, 1410 nt, Artificial Sequence; identical to SEQ ID NO: 48801
  neuraminidase__InfluenzaA__ADJ40527

SEQ ID NO: 49486 - RNA, 1410 nt, Artificial Sequence
  neuraminidase__InfluenzaA__ADJ40537
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagggguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauauaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauaucuuuuugugguguaaacagugacacuguggguuggucuuggccagacggugcugaguugccauuuaccauugacaaguaa

SEQ ID NO: 49487 - RNA, 1410 nt, Artificial Sequence
  neuraminidase__InfluenzaA__ADJ40547
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauaaucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuuuggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucauaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49488 - RNA, 1410 nt, Artificial Sequence; identical to SEQ ID NO: 48801
  neuraminidase__InfluenzaA__ADJ40557

SEQ ID NO: 49489 - RNA, 1410 nt, Artificial Sequence; identical to SEQ ID NO: 47707
  neuraminidase__InfluenzaA__ADJ40577

SEQ ID NO: 49490 - RNA, 1410 nt, Artificial Sequence; identical to SEQ ID NO: 47707
  neuraminidase__InfluenzaA__ADJ40587

SEQ ID NO: 49491 - RNA, 1410 nt, Artificial Sequence
  neuraminidase__InfluenzaA__ADJ40597
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucuuaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49492 - RNA, 1410 nt, Artificial Sequence
  neuraminidase__InfluenzaA__ADJ40607
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccaucaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49493 - RNA, 1410 nt, Artificial Sequence; identical to SEQ ID NO: 49492
  neuraminidase__InfluenzaA__ADJ40617

SEQ ID NO: 49494 - RNA, 1410 nt, Artificial Sequence
  neuraminidase__InfluenzaA__ADJ40627
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaggauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49495 - RNA, 1410 nt, Artificial Sequence; identical to SEQ ID NO: 47242
  neuraminidase__InfluenzaA__ADJ40637

SEQ ID NO: 49496 - RNA, 1410 nt, Artificial Sequence
  neuraminidase__InfluenzaA__ADJ40657
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauucuaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49497 - RNA, 1410 nt, Artificial Sequence; identical to SEQ ID NO: 47242
  neuraminidase__InfluenzaA__ADJ40667

SEQ ID NO: 49498 - RNA, 1410 nt, Artificial Sequence; identical to SEQ ID NO: 47242
  neuraminidase__InfluenzaA__ADJ40677

SEQ ID NO: 49499 - RNA, 1410 nt, Artificial Sequence
  neuraminidase__InfluenzaA__ADJ41819
augaauccaaaucaaaagauaauaacaauuggcucugucucucucaccauugcaacaauaugcuuccuuaugcaaauugccauccugguaacuacuguaacauugcauuucaagcaauaugagugcagcucccccccaaacaaccaaguagugccgugugaaccaauaauaauagaaagaaacauaacagagauaguguauuugacuaacaccaccauagagaaagagauaugccccaaacuaguggaauacagaaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacgcuagacaacaagcauucaaaugacacaauacaugauaggaccccuuaucgaacccuauugaugaaugaguuggguguuccauuucauuugggaaccaggcaaguguguauagcaugguccagcucaaguugucacgauggaaaagcauggcugcauguuuguaucacuggguaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauaccaaaauacuauucauugaagaggggaaaaucguucauauuagcccauugucaggaagugcucagcauguagaggaguguuccuguuauccucgauauccuggugucagaugugucugcagagacaacuggaaaggcuccaauaggcccgucguagauauaaaugugaaagauuauagcauuguuuccaguuaugugugcucagggcuuguuggcgacacacccagaaaaaacgacagaucuagcaguagcuauugccggaauccuaacaaugagaaagggaaucauggagugaaaggcugggccuuugacgauggaaaugacguguggaugggaagaacaaucagcgaggagucacgcucagguuaugaaaccuucaaagucauuggugguugguccacacccaauuccaaauugcagauaaauaggcaagucauaguugacagcgguaauagguccgguuauucugguauuuucucuguugagggcaaaagcugcaucaauaggugcuuuuauguggaguugauaaggggaagggaacaggaaacuagagucugguggaccucaaacagcauuguuguguuuuguggcacuucagguaccuauggaacaggcucauggccugauggagcggacaucaaucucaugccuauauaa

SEQ ID NO: 49500 - RNA, 1410 nt, Artificial Sequence; identical to SEQ ID NO: 47242
  neuraminidase__InfluenzaA__ADJ56642

SEQ ID NO: 49501 - RNA, 1410 nt, Artificial Sequence; identical to SEQ ID NO: 48462
  neuraminidase__InfluenzaA__ADJ56652

SEQ ID NO: 49502 - RNA, 1410 nt, Artificial Sequence; identical to SEQ ID NO: 47242
  neuraminidase__InfluenzaA__ADJ80637

SEQ ID NO: 49503 - RNA, 1410 nt, Artificial Sequence
  neuraminidase__InfluenzaA__ADJ80647
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaaggaacgguuuugagaugauuugggauccgaacggauggacugggacagacaauaacuucucaauaaagcaagauaucguaggaauaaaugaguggucaggauauagcgggaguuuuguucagcauccagaacuaacagggcugaauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49504 - RNA, 1410 nt, Artificial Sequence
  neuraminidase__InfluenzaA__ADJ80657
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaaggaacgguuuugagaugauuugggauccgaacggauggacugggacagacaauaacuucucaauaaaacaagauaucguaggaauaaaugaguggucaggauauagcgggaguuuuguucagcauccagaacuaacagggcugaauuguauaagaccuugcuucuggguugaacuaaucagagggcgacccaaagagaacacaaucuggacuagcgggagcagcauauccuuuugugguguaaacagugacacuguggguugguccuggccagacggugcugaguugccauuuaccauugacaaguaa

SEQ ID NO: 49505 - RNA, 1410 nt, Artificial Sequence; identical to SEQ ID NO: 47242
  neuraminidase__InfluenzaA__ADJ80667

SEQ ID NO: 49506 - RNA, 1410 nt, Artificial Sequence
  neuraminidase__InfluenzaA__ADJ80677
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcaucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49507 - RNA, 1410 nt, Artificial Sequence; identical to SEQ ID NO: 48530
  neuraminidase__InfluenzaA__ADJ80687

SEQ ID NO: 49508 - RNA, 1410 nt, Artificial Sequence
  neuraminidase__InfluenzaA__ADJ80697
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugauuuccgugaaauuagcaggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguuucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49509 - RNA, 1410 nt, Artificial Sequence
  neuraminidase__InfluenzaA__ADJ80717
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuguauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49510 - RNA, 1410 nt, Artificial Sequence
  neuraminidase__InfluenzaA__ADJ80727
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggauggguuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgaccuaaagagaacacaaucuggacuagcgggagcagcauauccuuuugugguguaaacagugacacuguggguuggucuuggccagacggugcugaguugccauuuaccauugacaaguaa

SEQ ID NO: 49511 - RNA, 1410 nt, Artificial Sequence
  neuraminidase__InfluenzaA__ADJ80737
augaauccaaaccaaaagauaauaaccauugguucggucuguauaacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauacagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49512 - RNA, 1410 nt, Artificial Sequence
  neuraminidase__InfluenzaA__ADJ80747
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaguuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaggggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguagaaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49513 - RNA, 1410 nt, Artificial Sequence
  neuraminidase__InfluenzaA__ADJ80757
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggguuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49514 - RNA, 1410 nt, Artificial Sequence
  neuraminidase__InfluenzaA__ADJ80767
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguacagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49515 - RNA, 1410 nt, Artificial Sequence
  neuraminidase__InfluenzaA__ADJ80777
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccugaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguuucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49516 - RNA, 1410 nt, Artificial Sequence; identical to SEQ ID NO: 48286
  neuraminidase__InfluenzaA__ADJ80787

SEQ ID NO: 49517 - RNA, 1410 nt, Artificial Sequence
  neuraminidase__InfluenzaA__ADJ80797
augaauccaaaccaaaagauaauaaccauugguucggucuguaugacaauuggaauggcuaacuuaauauuacaaauuggaaacauaaucucaauauggauuagccacucaauucaacuugggaauaaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuagaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49518 - RNA, 1410 nt, Artificial Sequence; identical to SEQ ID NO: 49504
  neuraminidase__InfluenzaA__ADJ80807

SEQ ID NO: 49519 - RNA, 1410 nt, Artificial Sequence
  neuraminidase__InfluenzaA__ADJ80817
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucggguccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49520 - RNA, 1410 nt, Artificial Sequence; identical to SEQ ID NO: 47242
  neuraminidase__InfluenzaA__ADJ80827

SEQ ID NO: 49521 - RNA, 1410 nt, Artificial Sequence
  neuraminidase__InfluenzaA__ADJ80837
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcaggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacgcuguggguuggucuuggccagacggugcugaguugccauuuaccauugacaaguaa

SEQ ID NO: 49522 - RNA, 1410 nt, Artificial Sequence; identical to SEQ ID NO: 49253
  neuraminidase__InfluenzaA__ADJ80851

SEQ ID NO: 49523 - RNA, 1410 nt, Artificial Sequence
  neuraminidase__InfluenzaA__ADJ80861
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucucccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggagcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgccuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguagguauaaaugaauggucaggauauagcgggaguuuuguucagcauccagaacuaacagggcuggauuguauaagaccuugcuucuggguugaauuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49524 - RNA, 1410 nt, Artificial Sequence
  neuraminidase__InfluenzaA__ADJ80871
augaauccaaaccaaaagauaauaaccauugguucggucuguaugacaauuggaauggcuaacuuaauauuacaaauuggaaacauaaucucaauauggauuagccacucaauucaacuugggaauaaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacugacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49525 - RNA, 1410 nt, Artificial Sequence
  neuraminidase__InfluenzaA__ADJ80886
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauuuugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguguguagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49526 - RNA, 1410 nt, Artificial Sequence
  neuraminidase__InfluenzaA__ADJ80896
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcaucauuacuuaugaaaacaacacuuggguaaaucagacauauguuaacaucagcaacaccaacuuugcugcuggacagucagugguuuccgugaaauuaacgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaucagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49527 - RNA, 1410 nt, Artificial Sequence
  neuraminidase__InfluenzaA__ADJ80913
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaguuccucucucugcccuguuaguggaugggcuauauacaguaaagacaacaguauaagaaucgguuccaagggggauguguuugucauaagggaaccauucauaucauguucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaagcgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49528 - RNA, 1410 nt, Artificial Sequence; identical to SEQ ID NO: 47242
  neuraminidase__InfluenzaA__ADJ80930

SEQ ID NO: 49529 - RNA, 1410 nt, Artificial Sequence; identical to SEQ ID NO: 48658
  neuraminidase__InfluenzaA__ADJ80950

SEQ ID NO: 49530 - RNA, 1410 nt, Artificial Sequence; identical to SEQ ID NO: 48530
  neuraminidase__InfluenzaA__ADJ80960

SEQ ID NO: 49531 - RNA, 1410 nt, Artificial Sequence
  neuraminidase__InfluenzaA__ADJ80970
augaauccaaaccaaaagauaauaaccauugguucggucuguaugacaauuggaauggcuaacuuaauauuacaaauuggaaacauaaucucaauauggauuagccacucaauucaacuugggaauaaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49532 - RNA, 1410 nt, Artificial Sequence
  neuraminidase__InfluenzaA__ADJ80980
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauauaguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49533 - RNA, 1410 nt, Artificial Sequence; identical to SEQ ID NO: 49524
  neuraminidase__InfluenzaA__ADJ80996

SEQ ID NO: 49534 - RNA, 1410 nt, Artificial Sequence
  neuraminidase__InfluenzaA__ADJ81006
augaauccaaaccaaaagauaauaaccauugguucggucuguaugacaauuggaauggcuaauuuaauauuacaaguuggaaacauaaucucaauauggauuagccacucaauucaacuugggaaucaaaaucagauugaaacaugcaaucaaagcaucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcacuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49535 - RNA, 1410 nt, Artificial Sequence; identical to SEQ ID NO: 49253
  neuraminidase__InfluenzaA__ADJ81016

SEQ ID NO: 49536 - RNA, 1410 nt, Artificial Sequence
  neuraminidase__InfluenzaA__ADJ81026
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucaguggauuccgugaaauuagcgggcaauuccucucucugcccuguuaguggaugggcuauauacaguaaagacaacaguauaagaaucgguuccaaaggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguauuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49537 - RNA, 1410 nt, Artificial Sequence
  neuraminidase__InfluenzaA__ADJ81036
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucaguagaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49538 - RNA, 1410 nt, Artificial Sequence
  neuraminidase__InfluenzaA__ADJ81046
augaauccaaaccaaaagauaauaaccauugguucggucuguaugacaguuggaauggcuaacuuaauauuacaaauuggaaacauaaucucaauauggauuagccacucuauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaauucaagaaacgguuuugagaugauuugggauccgaacggauggacugggacagacaauaacuucucaauaaagcaagauaucguaggaacaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49539 - RNA, 1410 nt, Artificial Sequence
  neuraminidase__InfluenzaA__ADJ81056
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguucccgugaaauuagcgggcaguuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaauucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49540 - RNA, 1410 nt, Artificial Sequence
  neuraminidase__InfluenzaA__ADJ81066
augaauccaaaccaaaagauaauaaccauugguucggucuguaugacaauuggaauggcuaacuuaauauuacagauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaauucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49541 - RNA, 1410 nt, Artificial Sequence; identical to SEQ ID NO: 47962
  neuraminidase__InfluenzaA__ADJ84775

SEQ ID NO: 49542 - RNA, 1410 nt, Artificial Sequence
  neuraminidase__InfluenzaA__ADJ88785
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcgucuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcguuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaaccauaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 49543 - RNA, 1410 nt, Artificial Sequence; identical to SEQ ID NO: 47242
  neuraminidase__InfluenzaA__ADK21716

SEQ ID NO: 49544 - RNA, 1410 nt, Artificial Sequence; identical to SEQ ID NO: 48286
  neuraminidase__InfluenzaA__ADK21726

SEQ ID NO: 49545 - RNA, 1410 nt, Artificial Sequence; identical to SEQ ID NO: 48651
  neuraminidase__InfluenzaA__ADK21736

SEQ ID NO: 49546 - RNA, 1410 nt, Artificial Sequence
  neuraminidase__InfluenzaA__ADK21746
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcaucauuacuuaugaacacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaagcgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 49547 - RNA, 1410 nt, Artificial Sequence; identical to SEQ ID NO: 48658
  neuraminidase__InfluenzaA__ADK21756

SEQ ID NO: 49548 - RNA, 1410 nt, Artificial Sequence
  neuraminidase__InfluenzaA__ADK21766
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcaugugugaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaccagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49549 - RNA, 1410 nt, Artificial Sequence
  neuraminidase__InfluenzaA__ADK21776
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauagcuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49550 - RNA, 1410 nt, Artificial Sequence; identical to SEQ ID NO: 48286
  neuraminidase__InfluenzaA__ADK21786

SEQ ID NO: 49551 - RNA, 1410 nt, Artificial Sequence
  neuraminidase__InfluenzaA__ADK21796
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuucacuguaaugaccgauggaccaagugauggacaggccucauacaagaucuucagaauagaaaagggaaagauagucaaaucagucgaaaugaaugccccuaauuaucauuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaaggaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49552 - RNA, 1410 nt, Artificial Sequence
  neuraminidase__InfluenzaA__ADK21806
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuugggugaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49553 - RNA, 1410 nt, Artificial Sequence
  neuraminidase__InfluenzaA__ADK21816
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcaggcaauuccucacucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguccccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49554 - RNA, 1410 nt, Artificial Sequence
  neuraminidase__InfluenzaA__ADK21826
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgcgaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggaggaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 49555 - RNA, 1410 nt, Artificial Sequence; identical to SEQ ID NO: 49330
  neuraminidase__InfluenzaA__ADK21836

SEQ ID NO: 49556 - RNA, 1410 nt, Artificial Sequence
  neuraminidase__InfluenzaA__ADK21846
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaaugaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucugggcuagcgggagcagcauauccuuuugugguguaaacagugacacuguggguuggucuuggccagacggugcugaguugccauuuaccauugacaaguaa

SEQ ID NO: 49557 - RNA, 1410 nt, Artificial Sequence
  neuraminidase__InfluenzaA__ADK21856
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuuacuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucaacauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49558 - RNA, 1410 nt, Artificial Sequence
  neuraminidase__InfluenzaA__ADK21866
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguauuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauugggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49559 - RNA, 1410 nt, Artificial Sequence
  neuraminidase__InfluenzaA__ADK21876
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucaaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacuggaacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49560 - RNA, 1410 nt, Artificial Sequence
  neuraminidase__InfluenzaA__ADK21886
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaauucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49561 - RNA, 1410 nt, Artificial Sequence
  neuraminidase__InfluenzaA__ADK21896
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaacaaaugaguggucaggauauagcgggaguuuuguccagcauccagaacuaacagggcuggauuguauaagaccuugcuucuggguugaacuaaucagagggcgacccaaagagaacacaauuuggacuagcgggagcagcauauccuuuugugguguaagcagugacacuguggguuggucuuggccagacggugcugaguugccauuuaccauugacaaguaa

SEQ ID NO: 49562 - RNA, 1410 nt, Artificial Sequence
  neuraminidase__InfluenzaA__ADK21906
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggauaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauugguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugggguaaacagugacacuguggguuggucuuggccggacggugcugaguugccauuuaccauugacaaguaa

SEQ ID NO: 49563 - RNA, 1410 nt, Artificial Sequence; identical to SEQ ID NO: 47439
  neuraminidase__InfluenzaA__ADK21916

SEQ ID NO: 49564 - RNA, 1410 nt, Artificial Sequence; identical to SEQ ID NO: 48796
  neuraminidase__InfluenzaA__ADK21926

SEQ ID NO: 49565 - RNA, 1410 nt, Artificial Sequence; identical to SEQ ID NO: 47242
  neuraminidase__InfluenzaA__ADK21936

SEQ ID NO: 49566 - RNA, 1410 nt, Artificial Sequence
  neuraminidase__InfluenzaA__ADK21946
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggauggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49567 - RNA, 1410 nt, Artificial Sequence
  neuraminidase__InfluenzaA__ADK21956
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggagccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaaaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacaguaacacuguggguuggucuuggccggacggugcugaguugccauuuaccauugacaaguaa

SEQ ID NO: 49568 - RNA, 1410 nt, Artificial Sequence; identical to SEQ ID NO: 48796
  neuraminidase__InfluenzaA__ADK32393

SEQ ID NO: 49569 - RNA, 1410 nt, Artificial Sequence; identical to SEQ ID NO: 48796
  neuraminidase__InfluenzaA__ADK32403

SEQ ID NO: 49570 - RNA, 1410 nt, Artificial Sequence; identical to SEQ ID NO: 48796
  neuraminidase__InfluenzaA__ADK32413

SEQ ID NO: 49571 - RNA, 1410 nt, Artificial Sequence
  neuraminidase__InfluenzaA__ADK32423
augaauccaaaccaaaagauaauaaccauugguucggucuguaugacaauuggaaugacuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagagaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49572 - RNA, 1410 nt, Artificial Sequence; identical to SEQ ID NO: 47242
  neuraminidase__InfluenzaA__ADK32433

SEQ ID NO: 49573 - RNA, 1410 nt, Artificial Sequence
  neuraminidase__InfluenzaA__ADK32443
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcaauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuagauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49574 - RNA, 1410 nt, Artificial Sequence
  neuraminidase__InfluenzaA__ADK32453
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuaucgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguuucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49575 - RNA, 1410 nt, Artificial Sequence
  neuraminidase__InfluenzaA__ADK32463
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugauaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49576 - RNA, 1410 nt, Artificial Sequence; identical to SEQ ID NO: 48286
  neuraminidase__InfluenzaA__ADK32473

SEQ ID NO: 49577 - RNA, 1410 nt, Artificial Sequence
  neuraminidase__InfluenzaA__ADK32483
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaagccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49578 - RNA, 1410 nt, Artificial Sequence; identical to SEQ ID NO: 48286
  neuraminidase__InfluenzaA__ADK32493

SEQ ID NO: 49579 - RNA, 1410 nt, Artificial Sequence
  neuraminidase__InfluenzaA__ADK32505
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcaucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagugggagcagcauauccuuuugugguguaaacagugacacuguggguuggucuuggccagacggugcugaguugccauuuaccauugacaaguaa

SEQ ID NO: 49580 - RNA, 1410 nt, Artificial Sequence
  neuraminidase__InfluenzaA__ADK32640
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucaguggccuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49581 - RNA, 1410 nt, Artificial Sequence; identical to SEQ ID NO: 47242
  neuraminidase__InfluenzaA__ADK32650

SEQ ID NO: 49582 - RNA, 1410 nt, Artificial Sequence; identical to SEQ ID NO: 48431
  neuraminidase__InfluenzaA__ADK32660

SEQ ID NO: 49583 - RNA, 1410 nt, Artificial Sequence
  neuraminidase__InfluenzaA__ADK32670
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuacuauugacaaguaa

SEQ ID NO: 49584 - RNA, 1410 nt, Artificial Sequence
  neuraminidase__InfluenzaA__ADK32680
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuauaaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49585 - RNA, 1410 nt, Artificial Sequence; identical to SEQ ID NO: 48286
  neuraminidase__InfluenzaA__ADK32690

SEQ ID NO: 49586 - RNA, 1410 nt, Artificial Sequence
  neuraminidase__InfluenzaA__ADK32700
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcuccccuuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucugguccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49587 - RNA, 1410 nt, Artificial Sequence
  neuraminidase__InfluenzaA__ADK32779
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauauaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49588 - RNA, 1410 nt, Artificial Sequence; identical to SEQ ID NO: 49148
  neuraminidase__InfluenzaA__ADK33614

SEQ ID NO: 49589 - RNA, 1410 nt, Artificial Sequence
  neuraminidase__InfluenzaA__ADK33624
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccggacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuacuauugacaaguaa

SEQ ID NO: 49590 - RNA, 1410 nt, Artificial Sequence
  neuraminidase__InfluenzaA__ADK33634
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggugccuugcuaaaugacaaacauuccaauggaaccauuaaagacaggagcccauaucgaacucuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaaaacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49591 - RNA, 1410 nt, Artificial Sequence
  neuraminidase__InfluenzaA__ADK33644
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcucagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49592 - RNA, 1410 nt, Artificial Sequence
  neuraminidase__InfluenzaA__ADK33654
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguauaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaauuuggacuagcgggagcagcauauccuuuugugguguaaacagugacacuguggguuggucuuggccagacggugcugaguugccauuuaccauugacaaguaa

SEQ ID NO: 49593 - RNA, 1410 nt, Artificial Sequence; identical to SEQ ID NO: 49592
  neuraminidase__InfluenzaA__ADK33664

SEQ ID NO: 49594 - RNA, 1410 nt, Artificial Sequence; identical to SEQ ID NO: 47242
  neuraminidase__InfluenzaA__ADK33674

SEQ ID NO: 49595 - RNA, 1410 nt, Artificial Sequence
  neuraminidase__InfluenzaA__ADK33684
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaauuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugacggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcggaaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49596 - RNA, 1410 nt, Artificial Sequence; identical to SEQ ID NO: 48668
  neuraminidase__InfluenzaA__ADK33694

SEQ ID NO: 49597 - RNA, 1410 nt, Artificial Sequence; identical to SEQ ID NO: 48286
  neuraminidase__InfluenzaA__ADK33704

SEQ ID NO: 49598 - RNA, 1410 nt, Artificial Sequence; identical to SEQ ID NO: 48797
  neuraminidase__InfluenzaA__ADK33714

SEQ ID NO: 49599 - RNA, 1410 nt, Artificial Sequence
  neuraminidase__InfluenzaA__ADK33744
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauauaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49600 - RNA, 1410 nt, Artificial Sequence
  neuraminidase__InfluenzaA__ADK33754
augaauccaaaccaaaagauaauaaccauugguucggucuguaugacaauuggaauggcuaacuucauacuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaacaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49601 - RNA, 1410 nt, Artificial Sequence
  neuraminidase__InfluenzaA__ADK33764
augaauccaaaccaaaagauaauaaccauugguucggucuguaugacaauuggaauggcuaacuucauacuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagaugggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaacaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49602 - RNA, 1410 nt, Artificial Sequence
  neuraminidase__InfluenzaA__ADK33774
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagugggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacugugaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagaugggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 49603 - RNA, 1410 nt, Artificial Sequence
  neuraminidase__InfluenzaA__ADK33784
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaauggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49604 - RNA, 1410 nt, Artificial Sequence
  neuraminidase__InfluenzaA__ADK33794
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaaaacaggcaguugugguccaguaucgucuaauggagcaaauggaguaaaaggauuuucauucaaauacggcaauggaguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaauaa

SEQ ID NO: 49605 - RNA, 1410 nt, Artificial Sequence; identical to SEQ ID NO: 48286
  neuraminidase__InfluenzaA__ADK33804

SEQ ID NO: 49606 - RNA, 1410 nt, Artificial Sequence
  neuraminidase__InfluenzaA__ADK33814
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaauaagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagaugggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 49607 - RNA, 1410 nt, Artificial Sequence
  neuraminidase__InfluenzaA__ADK33824
augaauccaaaccaaaagauaauaaccauugguucagucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauauuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaaaacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49608 - RNA, 1410 nt, Artificial Sequence; identical to SEQ ID NO: 49336
  neuraminidase__InfluenzaA__ADK33834

SEQ ID NO: 49609 - RNA, 1410 nt, Artificial Sequence
  neuraminidase__InfluenzaA__ADK33844
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgcgaaauuagcgggcaauuccccucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 49610 - RNA, 1410 nt, Artificial Sequence
  neuraminidase__InfluenzaA__ADK33854
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaaauucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49611 - RNA, 1410 nt, Artificial Sequence
  neuraminidase__InfluenzaA__ADK33864
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcugaacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauaggaagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacugaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49612 - RNA, 1410 nt, Artificial Sequence
  neuraminidase__InfluenzaA__ADK33874
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacaaucagugguuuccgugaaauuagcgggcaauuccucucucugcccuguuaguggaugggcuauauacaguaaagacaacaguauaagaaucgguuccaagggggacguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacuuaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49613 - RNA, 1410 nt, Artificial Sequence
  neuraminidase__InfluenzaA__ADK33884
augaauccaaaccaaaagauaauaaccauugguucggucuguaugacaauuggaauggcuaacuuaauauuacaaauuggaaacauaaucucaauauggauuagucacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugccccguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuucacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 49614 - RNA, 1410 nt, Artificial Sequence
  neuraminidase__InfluenzaA__ADK33894
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucaaacauauguuaacaucagcaacaccaacuuugcugcuggacagucagugguuuccgugaaauuagcgggcaauuccucucucugcccuguuaguggaugggcuauauacaguaaagacaacaguauaagaaucggcuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucguacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaaauucucaauaaagcaagauauuguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49615 - RNA, 1410 nt, Artificial Sequence; identical to SEQ ID NO: 49610
  neuraminidase__InfluenzaA__ADK33904

SEQ ID NO: 49616 - RNA, 1410 nt, Artificial Sequence; identical to SEQ ID NO: 49199
  neuraminidase__InfluenzaA__ADK33914

SEQ ID NO: 49617 - RNA, 1410 nt, Artificial Sequence
  neuraminidase__InfluenzaA__ADK33924
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacaguaacacuguggguuggucuuggccggacggugcugaguugccauuuaccauugacaaguaa

SEQ ID NO: 49618 - RNA, 1410 nt, Artificial Sequence
  neuraminidase__InfluenzaA__ADK33934
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacaaucagugguuuccgugaaauuagcgggcaauuccucucucugcccuguuaguggaugggcuauauacaguaaagacaacaguauaagaaucgguuccaagggggacguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagugggagcagcauauccuuuugugguguaaacagugacacuguggguuggucuuggccagacggugcugaguugccauuuaccauugacaaguaa

SEQ ID NO: 49619 - RNA, 1410 nt, Artificial Sequence; identical to SEQ ID NO: 47439
  neuraminidase__InfluenzaA__ADK33944

SEQ ID NO: 49620 - RNA, 1410 nt, Artificial Sequence
  neuraminidase__InfluenzaA__ADK33954
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauauaagaucuucagaauagaaaagggaaagauagucaaaucagucgaaaugaaugccccuaauuaucacuaugaggaaugcuccuguuauccugauucuaguaaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugaaaugauuugggauccgaacggauggacugggacagacaauaacuucucaauaaagcaagauaucguaggaauaaaugaguggucaggauauagcgggaguuuuguccagcauccagaacuaacagggcuggauuguauaagaccaugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49621 - RNA, 1410 nt, Artificial Sequence; identical to SEQ ID NO: 48286
  neuraminidase__InfluenzaA__ADK33964

SEQ ID NO: 49622 - RNA, 1410 nt, Artificial Sequence
  neuraminidase__InfluenzaA__ADK33974
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccaugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuucacuguaaugaccgauggaccaagugauggacaggccucauacaagaucuucagaauagaaaagggaaagauagucaaaucagucgaaaugaaugccccuaauuaucauuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 49623 - RNA, 1410 nt, Artificial Sequence; identical to SEQ ID NO: 47306
  neuraminidase__InfluenzaA__ADK33984

SEQ ID NO: 49624 - RNA, 1410 nt, Artificial Sequence
  neuraminidase__InfluenzaA__ADK39016
augaauccaaaccaaaagauaauaaccauugguucggucuguauaacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaguuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccggacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauucaccauugacaaguaa

SEQ ID NO: 49625 - RNA, 1410 nt, Artificial Sequence
  neuraminidase__InfluenzaA__ADK45315
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugauaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49626 - RNA, 1410 nt, Artificial Sequence
  neuraminidase__InfluenzaA__ADK45413
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcuguaugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauugcuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcgaacaucaaucucaugccuauauaa

SEQ ID NO: 49627 - RNA, 1410 nt, Artificial Sequence
  neuraminidase__InfluenzaA__ADK45424
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucaacaugucgaggagugcuccugcuauccucgauauccuggugucagaugugucugcagagacaacuggaaaggauccaauaggcccaucguagauauaaacauaaaggaucauagcauuguuuccaguuauuuguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucaucgaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49628 - RNA, 1410 nt, Artificial Sequence; identical to SEQ ID NO: 49436
  neuraminidase__InfluenzaA__ADK45446

SEQ ID NO: 49629 - RNA, 1410 nt, Artificial Sequence
  neuraminidase__InfluenzaA__ADK45457
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggacccccuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccggcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49630 - RNA, 1410 nt, Artificial Sequence
  neuraminidase__InfluenzaA__ADK45479
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcucuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcgucuguaucaauggaacuuguacaguaguaaugacugaugggagugcuucaggaaaagcugauacuaaaauacuauucauugaggaggggaaagucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaaccauaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaagcugaagucuuguggaccucaaacaguauuguuguguuuuguggcaccucagguacauauggaacaggcucauggccugauggggcggaccucaaucucaugccuauauaa

SEQ ID NO: 49631 - RNA, 1410 nt, Artificial Sequence; identical to SEQ ID NO: 48596
  neuraminidase__InfluenzaA__ADK48799

SEQ ID NO: 49632 - RNA, 1410 nt, Artificial Sequence; identical to SEQ ID NO: 49579
  neuraminidase__InfluenzaA__ADK62686

SEQ ID NO: 49633 - RNA, 1410 nt, Artificial Sequence; identical to SEQ ID NO: 49201
  neuraminidase__InfluenzaA__ADK62696

SEQ ID NO: 49634 - RNA, 1410 nt, Artificial Sequence
  neuraminidase__InfluenzaA__ADK64994
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccggaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49635 - RNA, 1410 nt, Artificial Sequence
  neuraminidase__InfluenzaA__ADK65002
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaccgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuggguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49636 - RNA, 1410 nt, Artificial Sequence; identical to SEQ ID NO: 47242
  neuraminidase__InfluenzaA__ADK65010

SEQ ID NO: 49637 - RNA, 1410 nt, Artificial Sequence
  neuraminidase__InfluenzaA__ADK65018
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacaaucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggccagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuauaaugaccgauggaccaagugauggacaggccucauacaagaucuucagaauagaaaagggaaagauagucaaaucaaucgaaaugaaugccccuaauuaucacuaugaggaaugcucauguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49638 - RNA, 1410 nt, Artificial Sequence
  neuraminidase__InfluenzaA__ADK87290
augaauccaaaucaaaagauaauaacgauuggcucuguuucucucaccauuuccacaauaugcuucuucaugcaaauugccaucuugauaacuacuguaacauugcauuucaagcaauacgaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcuuauacuaaaauauuauucauugaggagggaaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugauagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuguauaa

SEQ ID NO: 49639 - RNA, 1410 nt, Artificial Sequence
  neuraminidase__InfluenzaA__ADK87292
augaauccaaaucaaaagauaauaacgauuggcucuguuucucucaccauuuccacaauaugcuucuucaugcaaauugccaucuugauaacuacuguaacacugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguugucucaugguccaaagaaauccucaggacccaggagucagaaugcguuuguaucaauggaacuuguacaguaguaaugacugaugggagugcuucaggaaaagcugauacuaaaauauuauucauugaggagggaaaaaucguucauacuagcacauugucaggaagugcucagcaugucgaggagugcuccugcuauccucgauauccuggugucagaugugucugcagagacaacuggaaaggguccaauaggcccaucguagauauaaacauaaaggaucauagcauugucuccaguuaugcguguucaggacuuguuggagacacacccagaaaaaacgacagcuccagcaguagccauuguuuggauccuaacaaugaagaagguggucauggggugaaaggcugggccuuugaugauggaaaugacguguggaugggaagaacgaucagcgagaagucacgcuuaggguaugaaaccuucaaagucauugaaggcugguccaacccuaaguccaaacugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuguauaa

SEQ ID NO: 49640 - RNA, 1410 nt, Artificial Sequence
  neuraminidase__InfluenzaA__ADK87294
augaauccaaaucaaaagauaauagcgauuggcucuguuucucucaccauuuccacaauaugcuucuuccugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucgcgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggagggaaaaaucguucauacuagcacauugucaggaagugcucagcaugucgaggagugcuccugcuauccucgauauccuggugucagaugugucugcagagacacugggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaauauuguuguguuuuguggcaccucagguacauauggaacaggcucauggccugauggggcggacaucaaucucaugccuguauaa

SEQ ID NO: 49641 - RNA, 1410 nt, Artificial Sequence
  neuraminidase__InfluenzaA__ADK87297
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaaaacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49642 - RNA, 1410 nt, Artificial Sequence
  neuraminidase__InfluenzaA__ADK87299
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauucaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49643 - RNA, 1410 nt, Artificial Sequence
  neuraminidase__InfluenzaA__ADK87301
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguagcaaugacugaugggagugcuucaggaaaagcugauacuaaaauauuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaauccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49644 - RNA, 1410 nt, Artificial Sequence
  neuraminidase__InfluenzaA__ADK87303
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaauccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49645 - RNA, 1410 nt, Artificial Sequence
  neuraminidase__InfluenzaA__ADK87305
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccucaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggagggaaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgaaaagucacgcuuaggguaugaaaccuucaaagucauugaaggcugguccaacccuaaguccaaauugcagauaaauaggcaagucauaguuggcagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuguauaa

SEQ ID NO: 49646 - RNA, 1410 nt, Artificial Sequence
  neuraminidase__InfluenzaA__ADK87307
augaauccaaaucaaaagguaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggagggaaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguuggcagagguaauagguccgguuauucugguauuuucucuguugaaggcaaaagcugcaucaaucggugcuuuuauguggaguugauagggggaagaaaagaggaaacugaagucuuguggaccucaaacaguauuguuguguuuuguggcaccucagguacauauggaacaggcucauggccugauggggcggacaucaaucucaugccuguauag

SEQ ID NO: 49647 - RNA, 1410 nt, Artificial Sequence
  neuraminidase__InfluenzaA__ADK87312
augaauccaaaccaaacgauaauaaccauugguucggucuguaugacaauuggaauggcuaacuugauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugauuuccgugaaauuagcgggcaauuccucucucugcccuguuaguggaugggcuauauacaguaaagacaacaauauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauaucuuuuugugguguaaacagugacacuguggguuggucuuggccagacggugcugaguugccauuuaccauugacaaguaa

SEQ ID NO: 49648 - RNA, 1410 nt, Artificial Sequence
  neuraminidase__InfluenzaA__ADK87314
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaggaaacauaacagagauaguguaucugaccaacaccaccauagagaaggaaaugugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggagggaaaaaucguucauacuagcacaucgucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgaaaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuguauaa

SEQ ID NO: 49649 - RNA, 1410 nt, Artificial Sequence
  neuraminidase__InfluenzaA__ADK87316
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacacuaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaaauaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49650 - RNA, 1410 nt, Artificial Sequence
  neuraminidase__InfluenzaA__ADK87318
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucguacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuccuggguugaacuaaucagagggcgacccaaagagaacacaaucuggacuagcgggagcagcacauccuuuugugguguaaacagugacacuguggguuggucuuggccagacggugcugaguugccauuuaccauugacaaguaa

SEQ ID NO: 49651 - RNA, 1410 nt, Artificial Sequence
  neuraminidase__InfluenzaA__ADK87320
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguacaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcugaauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49652 - RNA, 1410 nt, Artificial Sequence
  neuraminidase__InfluenzaA__ADK87324
augaauccaaaucaaaagauaauaacgauuggcucuguuucucucaccauuuccacaauaugcuuccucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaagcuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccuggcaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugaugaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggagggaaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauuccgguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuguauaa

SEQ ID NO: 49653 - RNA, 1410 nt, Artificial Sequence
  neuraminidase__InfluenzaA__ADK87327
augaauccaaaucaaaagauaaugacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacagugguaaugacugaugggagugcuucaggaaaagcugauacuaaaauauuauucauugaggagggaaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucagggcuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaggucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacagcauuguuguguuuuguggcaccucagguacauauggaacaggcucauggccugauggggcggacaucaaucucaugccuguauaa

SEQ ID NO: 49654 - RNA, 1410 nt, Artificial Sequence
  neuraminidase__InfluenzaA__ADK87329
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcgagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49655 - RNA, 1410 nt, Artificial Sequence
  neuraminidase__InfluenzaA__ADK87330
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucugggcuagcgggagcagcauauccuuuugcgguguaaacagugacacuguggguuggucuuggccagacggugcugaguugccauuuaccauugacaaguaa

SEQ ID NO: 49656 - RNA, 1410 nt, Artificial Sequence
  neuraminidase__InfluenzaA__ADK87331
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacugaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49657 - RNA, 1410 nt, Artificial Sequence
  neuraminidase__InfluenzaA__ADK87332
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaagcacaacggcauaauaacagacacuaucaagaguuggagaaauaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggaaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49658 - RNA, 1410 nt, Artificial Sequence
  neuraminidase__InfluenzaA__ADK87333
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaauaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuaucccuauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggaaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49659 - RNA, 1410 nt, Artificial Sequence
  neuraminidase__InfluenzaA__ADK87335
augaauccaaaucaaaagauaauaacgauugguucuguuucucucaccauuuccacaauaugcuucuucaugcaaauugccaucuugauaacuacuguaacauugcauuucaagcaauaugaauucaacucccccccaaacaaccaagugaugcugugugagccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaggcguuaucaauuugcccuuggacagggaacaacacuaaacaacguacauucagauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaaaugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauagucgacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49660 - RNA, 1410 nt, Artificial Sequence
  neuraminidase__InfluenzaA__ADK87337
augaauccaaaucaaaagauaauaacgauugguucuguuucucucaccauuuccacaauaugcuucuucaugcaaauugccaucuugauaacuacuguaacauugcauuucaagcaauaugaauucaacucccccccaaacaaccaagugaugcugugugagccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacgcaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaaaugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugauagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49661 - RNA, 1410 nt, Artificial Sequence
  neuraminidase__InfluenzaA__ADK87339
augaauccaaaccaaaagauaauaaccauugguucgaucuguaugacaauuggaauggcuaauuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagcgcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacagguaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49662 - RNA, 1410 nt, Artificial Sequence; identical to SEQ ID NO: 47242
  neuraminidase__InfluenzaA__ADK90209

SEQ ID NO: 49663 - RNA, 1410 nt, Artificial Sequence
  neuraminidase__InfluenzaA__ADK90213
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaaaggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49664 - RNA, 1410 nt, Artificial Sequence; identical to SEQ ID NO: 49663
  neuraminidase__InfluenzaA__ADK90217

SEQ ID NO: 49665 - RNA, 1410 nt, Artificial Sequence
  neuraminidase__InfluenzaA__ADK90221
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccacaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaaggggaagauagucaaaucagucgaaaugaaugccccuaauuaccacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49666 - RNA, 1410 nt, Artificial Sequence
  neuraminidase__InfluenzaA__ADK90225
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccacaucgaacucuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaaggggaagauagucaaaucagucgaaaugaaugccccuaauuaccacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49667 - RNA, 1410 nt, Artificial Sequence
  neuraminidase__InfluenzaA__ADK90229
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucaaauaggauacauaugcagugggauuuucggagacaauccacgcccuaaugauaagacaggcaguugugguccaguaucgucuaauggagcaaauggagugaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49668 - RNA, 1410 nt, Artificial Sequence; identical to SEQ ID NO: 47439
  neuraminidase__InfluenzaA__ADK90233

SEQ ID NO: 49669 - RNA, 1410 nt, Artificial Sequence
  neuraminidase__InfluenzaA__ADK90241
augaauccaaaccaaaagauaauaaccauugguucggucuguaugacaaucggaauggcuaacuuaauauuacaaauuggaaacauaaucucaauauggauuagccacucaauucaacuugggaaucaaaaccagauugaaacaugcaaucaaagcgucauuacuuaugaaaacaacaccuggguaaaucagacauauguuaacaucagcaacgccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccacaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacaccaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaccacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49670 - RNA, 1410 nt, Artificial Sequence
  neuraminidase__InfluenzaA__ADK90245
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccacaucgaacucuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaaggggaagauagucaaaucagucgaaaugaaugccccuaauuaccacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcggaaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49671 - RNA, 1410 nt, Artificial Sequence
  neuraminidase__InfluenzaA__ADK90249
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagaaucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaaugggguaaaaggauuuucauucaaauacggcaaugguguuuggauagggagaacuaaaagcauuaguucaagaaacgguuuugagaugauuugggauccgaacggauggacugggacagacaauaacuucucaaugaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49672 - RNA, 1410 nt, Artificial Sequence; identical to SEQ ID NO: 49671
  neuraminidase__InfluenzaA__ADK90253

SEQ ID NO: 49673 - RNA, 1410 nt, Artificial Sequence
  neuraminidase__InfluenzaA__ADK90257
augaauccaaaccaaaagauaauaaucauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccacaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaaggggaagauagucaaaucagucgaaaugaaugccccuaauuaccacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49674 - RNA, 1410 nt, Artificial Sequence
  neuraminidase__InfluenzaA__ADK90261
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 49675 - RNA, 1410 nt, Artificial Sequence
  neuraminidase__InfluenzaA__ADK90265
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagaugggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49676 - RNA, 1410 nt, Artificial Sequence
  neuraminidase__InfluenzaA__ADK90269
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaaaaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucaaucgaaaugaaugcccccaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugagcuaaucagagggcgacccaaagagaacacaaucuggacuagcgggagcaucauauccuuuugugguguaaacagugacacuguggguuggucuuggccggacggugcugaguugccauuuaccauugacaaguaa

SEQ ID NO: 49677 - RNA, 1410 nt, Artificial Sequence; identical to SEQ ID NO: 47242
  neuraminidase__InfluenzaA__ADK90273

SEQ ID NO: 49678 - RNA, 1410 nt, Artificial Sequence; identical to SEQ ID NO: 48286
  neuraminidase__InfluenzaA__ADK90277

SEQ ID NO: 49679 - RNA, 1410 nt, Artificial Sequence; identical to SEQ ID NO: 47707
  neuraminidase__InfluenzaA__ADK90281

SEQ ID NO: 49680 - RNA, 1410 nt, Artificial Sequence
  neuraminidase__InfluenzaA__ADK90289
augaauccaaaccaaaagauaauaaccauugguucggucuguaugacaauuggaauggcuaacuuaauauuacaaauuggaaacauaaucucaauauggauuagccacucaauucaacuugggaaucaaaaucugauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucuucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaauauggacuagcgggagcagcauauccuuuugugguguaaacagugacacuguggguuggucuuggccagacggugcugaguugccauuuaccauugacaaguaa

SEQ ID NO: 49681 - RNA, 1410 nt, Artificial Sequence
  neuraminidase__InfluenzaA__ADK90293
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagagaaccauucauaucaugcucccccuuggaaugcagaaccuucuucuugacucaaggggccuugcuaaaugacaaacauuccaauggaaccauuaaagacaggagcccacaucgaacucuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccuagugauggacaggccucauacaagaucuucagaauagaaaaggggaagauagucaaaucagucgaaaugaaugccccuaauuaccacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49682 - RNA, 1410 nt, Artificial Sequence
  neuraminidase__InfluenzaA__ADK90297
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcugaacagucagugguuuccgugaaauuagcgggcaauuccucucucugcccuguuaguggaugggcuauauacaguaaagacaacaguauaagaaucgguuccaagggggauguguuugucauaagggaaccauucauaucaugcuccccauuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49683 - RNA, 1410 nt, Artificial Sequence
  neuraminidase__InfluenzaA__ADK90301
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguguccuucaaccagaaucuggaauaucagauaggauauauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49684 - RNA, 1410 nt, Artificial Sequence; identical to SEQ ID NO: 49682
  neuraminidase__InfluenzaA__ADK90305

SEQ ID NO: 49685 - RNA, 1410 nt, Artificial Sequence; identical to SEQ ID NO: 47242
  neuraminidase__InfluenzaA__ADK90309

SEQ ID NO: 49686 - RNA, 1410 nt, Artificial Sequence
  neuraminidase__InfluenzaA__ADK90313
augaauccaaaccacaaaauaauaaccauugguucggucuguaugacaaucggaauggcuaacuuaauauuacaaauuggaaacauaaucucaauauggauuagccacucaauucaacuugggaaucaaaaccagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccacaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacaccaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaccacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49687 - RNA, 1410 nt, Artificial Sequence
  neuraminidase__InfluenzaA__ADK90317
augaauccaaaccaaaagauaauaaccaucgguucggucuguaugacaauuggaauggcuaacuuaauauuacaaauuggaaacauaaucucaauauggauuagccacucaauucaacuggggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaacuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 49688 - RNA, 1410 nt, Artificial Sequence
  neuraminidase__InfluenzaA__ADK90321
augaauccaaaccaaaagauaauaaccauugguucggucuguaugacaaucggaauggcuaacuuaauauuacaaauuggaaacauaaucucaauauggauuagccacucaauucaacuugggaaucaaaaccagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccacaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacaccaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaccacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49689 - RNA, 1410 nt, Artificial Sequence
  neuraminidase__InfluenzaA__ADK90325
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugagguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49690 - RNA, 1410 nt, Artificial Sequence
  neuraminidase__InfluenzaA__ADK90329
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucgaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaaugaggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaaaacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49691 - RNA, 1410 nt, Artificial Sequence
  neuraminidase__InfluenzaA__ADK90333
augaauccaaaccaaaagauaauaaccauugguucggucuguaugacaauuggaauggcuaacuuaauauuacaaauuggaaacauaaucucaauauggauuagccacucaauucaacuugggaauaaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggagccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49692 - RNA, 1410 nt, Artificial Sequence; identical to SEQ ID NO: 49688
  neuraminidase__InfluenzaA__ADK90337

SEQ ID NO: 49693 - RNA, 1410 nt, Artificial Sequence
  neuraminidase__InfluenzaA__ADK90341
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuaacgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucguccaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49694 - RNA, 1410 nt, Artificial Sequence; identical to SEQ ID NO: 49693
  neuraminidase__InfluenzaA__ADK90345

SEQ ID NO: 49695 - RNA, 1410 nt, Artificial Sequence; identical to SEQ ID NO: 49693
  neuraminidase__InfluenzaA__ADK90349

SEQ ID NO: 49696 - RNA, 1410 nt, Artificial Sequence; identical to SEQ ID NO: 49688
  neuraminidase__InfluenzaA__ADK90353

SEQ ID NO: 49697 - RNA, 1410 nt, Artificial Sequence; identical to SEQ ID NO: 48430
  neuraminidase__InfluenzaA__ADK90357

SEQ ID NO: 49698 - RNA, 1410 nt, Artificial Sequence; identical to SEQ ID NO: 49688
  neuraminidase__InfluenzaA__ADK90361

SEQ ID NO: 49699 - RNA, 1410 nt, Artificial Sequence
  neuraminidase__InfluenzaA__ADK90365
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaauggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49700 - RNA, 1410 nt, Artificial Sequence; identical to SEQ ID NO: 48706
  neuraminidase__InfluenzaA__ADK90369

SEQ ID NO: 49701 - RNA, 1410 nt, Artificial Sequence
  neuraminidase__InfluenzaA__ADK90373
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaacauucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49702 - RNA, 1410 nt, Artificial Sequence
  neuraminidase__InfluenzaA__ADK90377
augaauccaaaccaaaagauaauaaccauugguucggucuguaugacaaucggaaugacuaacuuaauauuacaaauuggaaacauaaucucaauauggauuagccacucaauucaacuugggaaucaaaaccagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccacaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacaccaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaauggaugccccuaauuaccacuaugaggaaugcuccuguuauccugauucuagugaaaucauauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49703 - RNA, 1410 nt, Artificial Sequence
  neuraminidase__InfluenzaA__ADK90381
augaauccaaaccaaaagauaauaaccauugguucggucuguaugacaaucggaauggcuaacuuaauauuacaaauuggaaacauaaucucaauauggauuagccacucaauucaacuugggaaucaaaaccagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccacaucgaacccuaaugagcuguccuauuggugaaguucccuccccauauaacucaagauuugagucagucgcuuggucagcaagugcuugucaugauggcaucaauuggcuaacaauuggaauuucuggcccagacaauggggcaguggcuguguuaaaguacaacggcauaauaacagacaccaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaccacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49704 - RNA, 1410 nt, Artificial Sequence
  neuraminidase__InfluenzaA__ADK90385
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuaucgggcaauuccucucucugcccuguuaguggaugggcuauauacaguaaagacaacaguauaagaaucgguuccaaaggggauguguuugucauaagggaaccauucauaucaugcucccccuuggaaugcagaaccuucuucuugacucaaggggccuugcuaaaugacaaacauuccaauggaaccauuaaagacaggagcccacaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaauguacauguguaaaugguucuugcuuuacuguaaugaccgauggaccaagugauggacaggccucauacaagaucuucagaauagaaaagggaaagauagucaaaucagucgaaaugaaugccccuaauuaccacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49705 - RNA, 1410 nt, Artificial Sequence; identical to SEQ ID NO: 47242
  neuraminidase__InfluenzaA__ADK90389

SEQ ID NO: 49706 - RNA, 1410 nt, Artificial Sequence
  neuraminidase__InfluenzaA__ADK90393
augaauccaaaccaaaagauaauaaccauugguucggucuguaugacaaucggaauggcuaacuuaauauuacaaauuggaaacauaaucucaauauggauuagccacucaauucaacuugggaaucaaaaccagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggagauguguuugucauaagggaaccauucauaucaugcucccccuuggaaugcagaaccuucuucuugacucaaggggccuugcuaaaugacaaacauuccaauggaaccauuaaagacaggagcccacaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacaccaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaccacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49707 - RNA, 1410 nt, Artificial Sequence; identical to SEQ ID NO: 49682
  neuraminidase__InfluenzaA__ADK90397

SEQ ID NO: 49708 - RNA, 1410 nt, Artificial Sequence; identical to SEQ ID NO: 49667
  neuraminidase__InfluenzaA__ADK90401

SEQ ID NO: 49709 - RNA, 1410 nt, Artificial Sequence
  neuraminidase__InfluenzaA__ADK90405
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccacaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaauguacauguguaaaugguucuugcuuuacuguaaugaccgauggaccaagugauggacaggccucauacaagaucuucagaauagaaaagggaaagauagucaaaucagucgaaaugaaugccccuaauuaccacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49710 - RNA, 1410 nt, Artificial Sequence; identical to SEQ ID NO: 47707
  neuraminidase__InfluenzaA__ADK90409

SEQ ID NO: 49711 - RNA, 1410 nt, Artificial Sequence
  neuraminidase__InfluenzaA__ADK90413
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuaccuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccacaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaauggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaccacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49712 - RNA, 1410 nt, Artificial Sequence
  neuraminidase__InfluenzaA__ADK90417
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccgaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49713 - RNA, 1410 nt, Artificial Sequence
  neuraminidase__InfluenzaA__ADK90421
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugagguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauauaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49714 - RNA, 1410 nt, Artificial Sequence; identical to SEQ ID NO: 47242
  neuraminidase__InfluenzaA__ADK90425

SEQ ID NO: 49715 - RNA, 1410 nt, Artificial Sequence; identical to SEQ ID NO: 47242
  neuraminidase__InfluenzaA__ADK90429

SEQ ID NO: 49716 - RNA, 1410 nt, Artificial Sequence
  neuraminidase__InfluenzaA__ADK94194
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggacccccuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49717 - RNA, 1410 nt, Artificial Sequence
  neuraminidase__InfluenzaA__ADK94205
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcugaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49718 - RNA, 1410 nt, Artificial Sequence
  neuraminidase__InfluenzaA__ADK94216
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcgucuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaaccauaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 49719 - RNA, 1410 nt, Artificial Sequence
  neuraminidase__InfluenzaA__ADK94227
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaauauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49720 - RNA, 1410 nt, Artificial Sequence; identical to SEQ ID NO: 47962
  neuraminidase__InfluenzaA__ADK94238

SEQ ID NO: 49721 - RNA, 1410 nt, Artificial Sequence
  neuraminidase__InfluenzaA__ADK94260
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucaacaugucgaggagugcuccugcuauccucgauauccuggugucagaugugucugcagagacaacuggaaaggauccaauaggcccaucguagauauaaacauaaaggaucauagcauuguuuccaguuauuuguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49722 - RNA, 1410 nt, Artificial Sequence; identical to SEQ ID NO: 49721
  neuraminidase__InfluenzaA__ADK94271

SEQ ID NO: 49723 - RNA, 1410 nt, Artificial Sequence; identical to SEQ ID NO: 49719
  neuraminidase__InfluenzaA__ADK94293

SEQ ID NO: 49724 - RNA, 1410 nt, Artificial Sequence; identical to SEQ ID NO: 49719
  neuraminidase__InfluenzaA__ADK94304

SEQ ID NO: 49725 - RNA, 1410 nt, Artificial Sequence
  neuraminidase__InfluenzaA__ADK94326
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacauacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49726 - RNA, 1410 nt, Artificial Sequence; identical to SEQ ID NO: 49718
  neuraminidase__InfluenzaA__ADK94337

SEQ ID NO: 49727 - RNA, 1410 nt, Artificial Sequence; identical to SEQ ID NO: 49716
  neuraminidase__InfluenzaA__ADK94444

SEQ ID NO: 49728 - RNA, 1410 nt, Artificial Sequence
  neuraminidase__InfluenzaA__ADK94479
augaauccaaaucaaaagauaauaacgauuggcucuguuucucucaccauuuccacaauaugcuuccucaugcaaauugccauccugacaacuacuguaacauugcauuucaagcaauaugaauucaacucccccccaaacaaccaagugaugcugugugaaccaacaacaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguucccuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucaacaugucgaggagugcuccugcuauccucgauauccuggugucagaugugucugcagagacaacuggaaaggauccaauaggcccaucguagauauaaacauaaaggaucauagcauuguuuccaguuauuuguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacuggagucuuguggaccucaaacaguauuguuguguuuuguggcaccucagguacauauggaacaggcucauggccugauggggcggacaucaaucucaugccuauauaa

SEQ ID NO: 49729 - RNA, 1410 nt, Artificial Sequence; identical to SEQ ID NO: 49719
  neuraminidase__InfluenzaA__ADK94490

SEQ ID NO: 49730 - RNA, 1410 nt, Artificial Sequence; identical to SEQ ID NO: 47962
  neuraminidase__InfluenzaA__ADK94501

SEQ ID NO: 49731 - RNA, 1410 nt, Artificial Sequence
  neuraminidase__InfluenzaA__ADK94512
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaauauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggagaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49732 - RNA, 1410 nt, Artificial Sequence
  neuraminidase__InfluenzaA__ADK94534
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauaguauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49733 - RNA, 1410 nt, Artificial Sequence; identical to SEQ ID NO: 49721
  neuraminidase__InfluenzaA__ADK94556

SEQ ID NO: 49734 - RNA, 1410 nt, Artificial Sequence; identical to SEQ ID NO: 49732
  neuraminidase__InfluenzaA__ADK94567

SEQ ID NO: 49735 - RNA, 1410 nt, Artificial Sequence
  neuraminidase__InfluenzaA__ADK94578
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugagccaacaauaauagaaagaaacauaacagagauaguuuaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49736 - RNA, 1410 nt, Artificial Sequence
  neuraminidase__InfluenzaA__ADK94589
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauaggucugguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49737 - RNA, 1410 nt, Artificial Sequence
  neuraminidase__InfluenzaA__ADK98504
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugaguuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugacaagacaggcaguugugauccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49738 - RNA, 1410 nt, Artificial Sequence
  neuraminidase__InfluenzaA__ADK98506
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaaacgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49739 - RNA, 1410 nt, Artificial Sequence
  neuraminidase__InfluenzaA__ADK98626
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaaugauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucaacaugucgaggagugcuccugcuauccucgauauccuggugucagaugugucugcagagacaacuggaaaggauccaauaggcccaucguagauauaaacauaaaggaucauagcauuguuuccaguuauuuguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucaucgaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49740 - RNA, 1410 nt, Artificial Sequence
  neuraminidase__InfluenzaA__ADK98637
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauuaaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcgucuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaaccauaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 49741 - RNA, 1410 nt, Artificial Sequence
  neuraminidase__InfluenzaA__ADK98648
augaauccaaaucaaaagauaauaacgauuggcucuguuucucucaccauuuccacaauaugcuucuucaugcaaauugccaucuugguaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcuugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucguggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcgaacaucaaucucaugccuauauaa

SEQ ID NO: 49742 - RNA, 1410 nt, Artificial Sequence
  neuraminidase__InfluenzaA__ADK98659
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauauagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcgucuguaucaauggaacuuguacaguaguaaugacugaugggagugcuucaggaaaagcugauacuaaaauacuauucauugaggaggggaaaaucguucauaccagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguggccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcuggucaaaccauaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 49743 - RNA, 1410 nt, Artificial Sequence; identical to SEQ ID NO: 49721
  neuraminidase__InfluenzaA__ADK98670

SEQ ID NO: 49744 - RNA, 1410 nt, Artificial Sequence
  neuraminidase__InfluenzaA__ADK98681
augaauccaaaucaaaagauaauaacgauuggcucuguuucucucaccauuuccacaauaugcuucuucaugcagauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuugggcagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggagaagcugauacuaaaauacuauucauugaggaggggaagaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggggacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagacaaauaggcaagucauaguugacagagguaauagguccgguuauucugguauuuucucuguugaaggcaaaaacugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49745 - RNA, 1410 nt, Artificial Sequence
  neuraminidase__InfluenzaA__ADK98703
augaauccaaaucaaaagauaauaacgauuggcucuguuucucucaccauuuccacaauaugcuucuucaugcagacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuugggcagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggagaagcugauacuaaaauacuauucauugaggaggggaagaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggggacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagacaaauaggcaagucauaguugacagagguaauagguccgguuauucugguauuuucucuguugaaggcaaaaacugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49746 - RNA, 1410 nt, Artificial Sequence
  neuraminidase__InfluenzaA__ADK98725
augaauccaaaucaaaagauaauaacgauuggcucuguuucucucaccauuuccacaauaugcuucuucaugcaaauugccaucuugguaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcgaacaucaaucucaugccuauauaa

SEQ ID NO: 49747 - RNA, 1410 nt, Artificial Sequence; identical to SEQ ID NO: 49627
  neuraminidase__InfluenzaA__ADK98736

SEQ ID NO: 49748 - RNA, 1410 nt, Artificial Sequence
  neuraminidase__InfluenzaA__ADK98747
augaauccaaaucaaaagauaauaacgauuggcucuguuucucucaccauuuccacaauaugcuucuucaugcaaauugccaucuugguaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcuugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacaugaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcgaacaucaaucucaugccuauauaa

SEQ ID NO: 49749 - RNA, 1410 nt, Artificial Sequence
  neuraminidase__InfluenzaA__ADK98758
augaauccaaaucaaaagauaauaacgauuggcucuguuucucucaccauuuccacaauaugcuucuucaugcaaauugccaucuugguaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcuugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuuguacaguaguaaugacugaugggagugcuucaggaaaagcuaauacuaaaauacuauucauugaggaggggaaaaucguucauacuagcacauugucaggaagugcucagcaugucgaggagugcuccugcuauccucgauauccuggugucagaugugucugcagagacaacuggaagggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucuggcauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcgaacaucaaucucaugccuauauaa

SEQ ID NO: 49750 - RNA, 1410 nt, Artificial Sequence; identical to SEQ ID NO: 49746
  neuraminidase__InfluenzaA__ADK98769

SEQ ID NO: 49751 - RNA, 1410 nt, Artificial Sequence; identical to SEQ ID NO: 49542
  neuraminidase__InfluenzaA__ADK98780

SEQ ID NO: 49752 - RNA, 1410 nt, Artificial Sequence
  neuraminidase__InfluenzaA__ADK98791
augaauccaaaucaaaagauaauaacgauuggcucuguuucucucaccauuuccacaauaugcuucuucaugcaaauugccaucuugguaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcgaacaucaaucucaugccuauauaa

SEQ ID NO: 49753 - RNA, 1410 nt, Artificial Sequence; identical to SEQ ID NO: 49625
  neuraminidase__InfluenzaA__ADK98802

SEQ ID NO: 49754 - RNA, 1410 nt, Artificial Sequence
  neuraminidase__InfluenzaA__ADK98813
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccagcaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugagcuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcgucuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaaccauaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 49755 - RNA, 1410 nt, Artificial Sequence
  neuraminidase__InfluenzaA__ADK98824
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49756 - RNA, 1410 nt, Artificial Sequence; identical to SEQ ID NO: 49746
  neuraminidase__InfluenzaA__ADK98835

SEQ ID NO: 49757 - RNA, 1410 nt, Artificial Sequence; identical to SEQ ID NO: 49721
  neuraminidase__InfluenzaA__ADK98846

SEQ ID NO: 49758 - RNA, 1410 nt, Artificial Sequence
  neuraminidase__InfluenzaA__ADK98857
augaauccaaaucaaaagauaauaacgauuggcucuguuucucucaccauuuccacaauaugcuucuucaugcaaauugccaucuugguaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaaccauaaguccaaauugcagauaaauaggcaagucauaguugacagagguaauagguccgguuauucugguauuuuuucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcgaacaucaaucucaugccuauauaa

SEQ ID NO: 49759 - RNA, 1410 nt, Artificial Sequence
  neuraminidase__InfluenzaA__ADK98868
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauugucuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaaugaagucuuguggaccucaaacaguauuguuguguuuuguggcaccucagguacauauggaacaggcucauggccugauggggcggacaucaaucucaugccuauauaa

SEQ ID NO: 49760 - RNA, 1410 nt, Artificial Sequence
  neuraminidase__InfluenzaA__ADK98879
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagcgaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuugcacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauuguuuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49761 - RNA, 1410 nt, Artificial Sequence; identical to SEQ ID NO: 49721
  neuraminidase__InfluenzaA__ADK98890

SEQ ID NO: 49762 - RNA, 1410 nt, Artificial Sequence
  neuraminidase__InfluenzaA__ADK98901
augaauccaaaucaaaagauaauaacgauuggcucuguuucucucaccauuuccacaauaugcuucuucaugcaaauugccaucuugguaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcuugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgguauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcgaacaucaaucucaugccuauauaa

SEQ ID NO: 49763 - RNA, 1410 nt, Artificial Sequence; identical to SEQ ID NO: 49542
  neuraminidase__InfluenzaA__ADK98912

SEQ ID NO: 49764 - RNA, 1410 nt, Artificial Sequence
  neuraminidase__InfluenzaA__ADK98923
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucaacaugucgaggaaugcuccugcuauccucgauauccuggugucagaugugucugcagagacaacuggaaaggauccaauaggcccaucguagauauaaacauaaaggaucauagcauuguuuccaguuauuuguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucaucgaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49765 - RNA, 1410 nt, Artificial Sequence
  neuraminidase__InfluenzaA__ADK98945
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcgucuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaaccauaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacguauggaacaggcucauggccugauggggcggaccucaaucucaugccuauauaa

SEQ ID NO: 49766 - RNA, 1410 nt, Artificial Sequence
  neuraminidase__InfluenzaA__ADK98956
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcgucuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcguuguuuccaguuauguguguucaggacuuguuggagacacacccagaaaaagcgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaaccauaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 49767 - RNA, 1410 nt, Artificial Sequence; identical to SEQ ID NO: 49746
  neuraminidase__InfluenzaA__ADK98967

SEQ ID NO: 49768 - RNA, 1410 nt, Artificial Sequence; identical to SEQ ID NO: 49721
  neuraminidase__InfluenzaA__ADK98978

SEQ ID NO: 49769 - RNA, 1410 nt, Artificial Sequence; identical to SEQ ID NO: 49766
  neuraminidase__InfluenzaA__ADK98989

SEQ ID NO: 49770 - RNA, 1410 nt, Artificial Sequence
  neuraminidase__InfluenzaA__ADK99000
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaauauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucgaacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49771 - RNA, 1410 nt, Artificial Sequence; identical to SEQ ID NO: 49766
  neuraminidase__InfluenzaA__ADK99011

SEQ ID NO: 49772 - RNA, 1410 nt, Artificial Sequence
  neuraminidase__InfluenzaA__ADK99022
augaauccaaaucaaaagauaauaacgauuggcucuguuucucucaccauuuccacaauaugcuucuucaugcaaauugccaucuugguaaccacuguaacauugcauuucaagcaauaugaauucaacucccccccaaacaaccaagugaugcugugugacccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcgaacaucaaucucaugccuauauaa

SEQ ID NO: 49773 - RNA, 1410 nt, Artificial Sequence
  neuraminidase__InfluenzaA__ADK99033
augaauccaaaucaaaagauaauaacuauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggagauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuugcacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaccauagcauuguuuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49774 - RNA, 1410 nt, Artificial Sequence
  neuraminidase__InfluenzaA__ADK99044
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacaaaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgggcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcgucuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaacuuucaaagucauugaaggcugguccaaccauaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 49775 - RNA, 1410 nt, Artificial Sequence
  neuraminidase__InfluenzaA__ADK99055
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggauccaauaggcccaucguagauauaaacaugaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49776 - RNA, 1410 nt, Artificial Sequence
  neuraminidase__InfluenzaA__ADK99066
augaauccaaaucaaaagauaauaacgauuggcucuguuucucucaccauuuccacaauaugcuucuucaugcaaauugccaucuugauaacuacuguaacauugcauuucaagcaaugugaauucaacucccccccaaacaaccaagugaugcugugugaaccaacaauaauagaaagaaacauaacagagauaguguaucugaccaacaccaccauagagaagaaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucaacaugucgaggagugcuccugcuauccucgauauccuggugucagaugugucugcagagacaacuggaaaggauccaauaggcccaucguagauauaaacauaaaggaucauagcauuguuuccaguuauuuguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucaucgaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcgaacaucaaucucaugccuauauaa

SEQ ID NO: 49777 - RNA, 1410 nt, Artificial Sequence
  neuraminidase__InfluenzaA__ADK99077
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcucuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucaugauggaaaagcauggcugcauguuuguauaacgggggaugauaaaaaugcaacugcuagcuucauuuacaaugggaggcuuguagauaguguuguuucaugguccaaagacauccucaggacccaggagucagaaugcgucuguaucaauggaacuuguacaguaguaaugacugaugggagugcuucaggaaaagcugauacuaaaauacuauucauugaggaggggaaagucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaaccauaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 49778 - RNA, 1410 nt, Artificial Sequence; identical to SEQ ID NO: 49542
  neuraminidase__InfluenzaA__ADK99088

SEQ ID NO: 49779 - RNA, 1410 nt, Artificial Sequence
  neuraminidase__InfluenzaA__ADK99099
augaauccaaaucaaaagauaauaacgauuggcucuguuucucucaccauuuccacaauaugcuucuucaugcaaauugccaucuugguaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcuugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcgaacaucaaucucaugccuauauaa

SEQ ID NO: 49780 - RNA, 1410 nt, Artificial Sequence
  neuraminidase__InfluenzaA__ADK99110
augaauccaaaucaaaagauaauaacgauuggcucuguuucucucaccauuuccacaauaugcuucuucaugcaaauugccaucuugguaacuacuguaacauugcauuucaagcaauaugaauucaacccccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcgaacaucaaucucaugccuauauaa

SEQ ID NO: 49781 - RNA, 1410 nt, Artificial Sequence; identical to SEQ ID NO: 49721
  neuraminidase__InfluenzaA__ADK99121

SEQ ID NO: 49782 - RNA, 1410 nt, Artificial Sequence
  neuraminidase__InfluenzaA__ADK99132
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccguagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucaacaugucgaggagugcuccugcuauccucgauauccuggugucagaugugucugcagagacaacuggaaaggauccaauaggcccaucguagauauaaacauaaaggaucauagcauuguuuccaguuauuuguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49783 - RNA, 1410 nt, Artificial Sequence; identical to SEQ ID NO: 49721
  neuraminidase__InfluenzaA__ADK99143

SEQ ID NO: 49784 - RNA, 1410 nt, Artificial Sequence; identical to SEQ ID NO: 49719
  neuraminidase__InfluenzaA__ADK99154

SEQ ID NO: 49785 - RNA, 1410 nt, Artificial Sequence
  neuraminidase__InfluenzaA__ADK99176
augaauccaaaucaaaagauaauaacgauuggcucuguuucucucaccauuuccacaauaugcuucuucaugcaaauugccaucuugguaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccucaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcuugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcgaacaucaaucucaugccuauauaa

SEQ ID NO: 49786 - RNA, 1410 nt, Artificial Sequence; identical to SEQ ID NO: 49777
  neuraminidase__InfluenzaA__ADK99187

SEQ ID NO: 49787 - RNA, 1410 nt, Artificial Sequence; identical to SEQ ID NO: 49752
  neuraminidase__InfluenzaA__ADK99198

SEQ ID NO: 49788 - RNA, 1410 nt, Artificial Sequence; identical to SEQ ID NO: 49721
  neuraminidase__InfluenzaA__ADK99220

SEQ ID NO: 49789 - RNA, 1410 nt, Artificial Sequence
  neuraminidase__InfluenzaA__ADK99231
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaauuguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucaacaugucgaggagugcuccugcuauccucgauauccuggugucagaugugucugcagagacaacuggaaaggauccaauaggcccaucguagauauaaacauaaaggaucauagcauuguuuccaguuauuuguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucaucgaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49790 - RNA, 1410 nt, Artificial Sequence
  neuraminidase__InfluenzaA__ADK99242
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggauggggagaacgaucagcgagaagucacgcuuaggguaugaaaccuucaaagucauugaagguugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuauuguguuuuguggcaccucagguacauauggaacaggcucauggccugauggggcggacaucaaucucaugccuauauaa

SEQ ID NO: 49791 - RNA, 1410 nt, Artificial Sequence
  neuraminidase__InfluenzaA__ADK99253
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcuuggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggcauuugaugauggaaaugacguguggaugggaagaacgaucagcgagaagucacgcuuaggguaugaaaccuucaaagucauugaaggcugguccaaccauaaguccaaauugcagauaaauaggcaagucauaguugacagaggucauagguccgguuauucugguauuuucucuguugaaggcaaaagcugcaucaaucgaugcuuuuauguggaguugauuaggggaagaaaagaggaaacugaagucuuguggaccucaaacaguauuguuguguuuuguggcaccucagguacauauggaacaggcucauggccugauggggcggaccucacucucaugccuauauaa

SEQ ID NO: 49792 - RNA, 1410 nt, Artificial Sequence
  neuraminidase__InfluenzaA__ADK99264
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucaacaugucgaggagugcuccugcuauccucgauauccuggugucagaugugucugcagagacaacuggaaaggauccaauaggcccaucguagauauaaacauaaaggaucauagcauuguuuccaguuauuuguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcauauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49793 - RNA, 1410 nt, Artificial Sequence
  neuraminidase__InfluenzaA__ADK99275
augaauccaaaucaaaagauaauaacgauuggcucuguuucucucaccauuuccacaauaugcuucuuuaugcaaauugccgucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcaggauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaaguaugcauagcaugguccagcucaaguugucacgauggaaaagcauggcugcauguuuguauaacgggggaugauaaaaaugcaacugcuagcuuuauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucgaugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 49794 - RNA, 1410 nt, Artificial Sequence
  neuraminidase__InfluenzaA__ADK99286
augaauccaaaucaaaagauaauaacgauuggcucuguuucucucaccauuuccacaauaugcuucuucaugcaaauugccaucuugauaacuacuguaacauugcauuucaagcaauaugaauucaacccccccccaaacaaccaagugacgccgcgugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacauacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49795 - RNA, 1410 nt, Artificial Sequence
  neuraminidase__InfluenzaA__ADK99297
augaauccaaaucaaaagauaauaacgauuggcucuguuucucucaccauuuccacaauaugcuucuucaugcaaaccgccauccugauaacuacuguaacauugcauuucaagcaaugugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaaaucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaaggaaagaggaaacugaagucuuguggaccucaaacaguauuguuguguuuuguggcaccucagguacauauggaacaggcucauggccugauggggcggacaucaaucucaugccuauauaa

SEQ ID NO: 49796 - RNA, 1410 nt, Artificial Sequence
  neuraminidase__InfluenzaA__ADK99308
augaauccaaaucaaaagauaauaacgauuggcucuguuucucucaccauuuccacaauaugcuucuucaugcaaauugccaucuugguaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguauuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagucauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcgaacaucaaucucaugccuauauaa

SEQ ID NO: 49797 - RNA, 1413 nt, Artificial Sequence
  neuraminidase__InfluenzaA__ADL14590
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaagacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 49798 - RNA, 1410 nt, Artificial Sequence; identical to SEQ ID NO: 49752
  neuraminidase__InfluenzaA__ADL27992

SEQ ID NO: 49799 - RNA, 1410 nt, Artificial Sequence; identical to SEQ ID NO: 49627
  neuraminidase__InfluenzaA__ADL28003

SEQ ID NO: 49800 - RNA, 1410 nt, Artificial Sequence; identical to SEQ ID NO: 49772
  neuraminidase__InfluenzaA__ADL28014

SEQ ID NO: 49801 - RNA, 1410 nt, Artificial Sequence
  neuraminidase__InfluenzaA__ADL28025
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaagaaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucaacaugucgaggagugcuccugcuauccucgauauccuggugucagaugugucugcagagacaacuggaaaggauccaauaggcccaucguagauauaaacauaaaggaucauagcauuguuuccaguuauuuguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49802 - RNA, 1410 nt, Artificial Sequence; identical to SEQ ID NO: 49762
  neuraminidase__InfluenzaA__ADL28036

SEQ ID NO: 49803 - RNA, 1410 nt, Artificial Sequence; identical to SEQ ID NO: 49625
  neuraminidase__InfluenzaA__ADL28047

SEQ ID NO: 49804 - RNA, 1410 nt, Artificial Sequence
  neuraminidase__InfluenzaA__ADL28058
augaauccaaaucaaaagauaauaacgauuggcucuguuucucucaccauuuccacaauaugcuucuucaugcaaauugccaucuuaauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccucaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcgucuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagugagaagucacgcuuaggguaugaaacuuucaaagucauugaaggcugguccaaccauaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaaguccuguggaccucaaacaguauuguuguguuuuguggcaccucagguacauauggaacaggcucauggccugauggggcggaucucaaucucaugccuauauaa

SEQ ID NO: 49805 - RNA, 1410 nt, Artificial Sequence; identical to SEQ ID NO: 49780
  neuraminidase__InfluenzaA__ADL28069

SEQ ID NO: 49806 - RNA, 1410 nt, Artificial Sequence; identical to SEQ ID NO: 49721
  neuraminidase__InfluenzaA__ADL28080

SEQ ID NO: 49807 - RNA, 1410 nt, Artificial Sequence; identical to SEQ ID NO: 49746
  neuraminidase__InfluenzaA__ADL28091

SEQ ID NO: 49808 - RNA, 1410 nt, Artificial Sequence
  neuraminidase__InfluenzaA__ADL28102
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugucccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacacugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49809 - RNA, 1410 nt, Artificial Sequence; identical to SEQ ID NO: 47962
  neuraminidase__InfluenzaA__ADL28113

SEQ ID NO: 49810 - RNA, 1410 nt, Artificial Sequence
  neuraminidase__InfluenzaA__ADL28129
augaauccaaaucaaaagauaauaacgauuggcucuguuucucucaccauuuccacaauaugcuucuucaugcaaauugccaucuugguaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcuugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaaaucuuguggaccucaaacaguauuguuguguuuuguggcaccucagguacauauggaacaggcucauggccugauggggcgaacaucaaucucaugccuauauaa

SEQ ID NO: 49811 - RNA, 1410 nt, Artificial Sequence
  neuraminidase__InfluenzaA__ADL28140
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcacccuuuucuaaggacaauucaauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgaugggaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaagaggggaaaaucguucauacuagcacauuaucaggaagugcucagcaugucgaggagugcuccuguuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaauccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcgaacaucaaucucaugccuauauaa

SEQ ID NO: 49812 - RNA, 1410 nt, Artificial Sequence; identical to SEQ ID NO: 49752
  neuraminidase__InfluenzaA__ADL28151

SEQ ID NO: 49813 - RNA, 1410 nt, Artificial Sequence; identical to SEQ ID NO: 49718
  neuraminidase__InfluenzaA__ADL28162

SEQ ID NO: 49814 - RNA, 1410 nt, Artificial Sequence
  neuraminidase__InfluenzaA__ADL28173
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaagcuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucaacaugucgaggagugcuccugcuauccucgauauccuggugucagaugugucugcagagacaacuggaaaggauccaauaggcccaucguagauauaaacauaaaggaucauagcauuguuuccaguuauuuguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucaucgaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49815 - RNA, 1410 nt, Artificial Sequence; identical to SEQ ID NO: 49779
  neuraminidase__InfluenzaA__ADL28184

SEQ ID NO: 49816 - RNA, 1410 nt, Artificial Sequence
  neuraminidase__InfluenzaA__ADL28195
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggacccccuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuugugucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucgggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49817 - RNA, 1410 nt, Artificial Sequence; identical to SEQ ID NO: 49777
  neuraminidase__InfluenzaA__ADL28206

SEQ ID NO: 49818 - RNA, 1410 nt, Artificial Sequence; identical to SEQ ID NO: 48096
  neuraminidase__InfluenzaA__ADL28217

SEQ ID NO: 49819 - RNA, 1410 nt, Artificial Sequence; identical to SEQ ID NO: 49746
  neuraminidase__InfluenzaA__ADL28228

SEQ ID NO: 49820 - RNA, 1410 nt, Artificial Sequence; identical to SEQ ID NO: 49764
  neuraminidase__InfluenzaA__ADL28239

SEQ ID NO: 49821 - RNA, 1410 nt, Artificial Sequence; identical to SEQ ID NO: 49436
  neuraminidase__InfluenzaA__ADL28250

SEQ ID NO: 49822 - RNA, 1410 nt, Artificial Sequence; identical to SEQ ID NO: 49721
  neuraminidase__InfluenzaA__ADL28261

SEQ ID NO: 49823 - RNA, 1410 nt, Artificial Sequence
  neuraminidase__InfluenzaA__ADL28373
augaauccaaaucaaaagauaauaacgauuggcucuguuucucucaccauuuccacaauaugcuucuucaugcaaauugccaucuugguaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcgaacaucaaucucaugccuauauaa

SEQ ID NO: 49824 - RNA, 1410 nt, Artificial Sequence
  neuraminidase__InfluenzaA__ADL28387
augaauccaaaucaaaagauaauaacgauuggcucuguuucucucaccauuuccacaauaugcuucuucaugcaaauugccaucuugauaacuacuguaacauugcauuucaagcaauaugaauucaacuccuccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagucugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugacgggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49825 - RNA, 1410 nt, Artificial Sequence
  neuraminidase__InfluenzaA__ADL28391
augaauccaaaucaaaagauaauaacgauuggcucuguuucucucaccauuuccacaauaugcuucuucaugcaaauugccaucuugauaacuacuguaacauugcauuucaagcaauaugaauucaacuccuccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagaguaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagucugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugacgggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49826 - RNA, 1410 nt, Artificial Sequence
  neuraminidase__InfluenzaA__ADL28395
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccagcaauaauagaaagaaacauaacagagauaguguaucugaccaacaccaccauagagaaggaaauaugccccaaauuagcagaauacagaaauuggucaaagccgcaauguaacauuacaggauuugcaccuuuuuccaaggacaauucgauucggcuuuccgcugguggggacaucugggugacaagaguaccuuaugugucaugcgauccugacaaguguuaucaauuugcccuuggacagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguuaauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuucgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaaguuugguggaccucaaacaguauuguuguguuuuguggcaccucagguacauauggaacaggcucauggccugauggggcggauaucaaucucaugccuauauaa

SEQ ID NO: 49827 - RNA, 1410 nt, Artificial Sequence; identical to SEQ ID NO: 47242
  neuraminidase__InfluenzaA__ADL29675

SEQ ID NO: 49828 - RNA, 1410 nt, Artificial Sequence; identical to SEQ ID NO: 47242
  neuraminidase__InfluenzaA__ADL29685

SEQ ID NO: 49829 - RNA, 1410 nt, Artificial Sequence
  neuraminidase__InfluenzaA__ADL29695
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacauuguggguuggucuuggccagacggugcugaguugccauuuaccauugacaaguaa

SEQ ID NO: 49830 - RNA, 1410 nt, Artificial Sequence; identical to SEQ ID NO: 48608
  neuraminidase__InfluenzaA__ADL29705

SEQ ID NO: 49831 - RNA, 1410 nt, Artificial Sequence; identical to SEQ ID NO: 49829
  neuraminidase__InfluenzaA__ADL29733

SEQ ID NO: 49832 - RNA, 1410 nt, Artificial Sequence; identical to SEQ ID NO: 49496
  neuraminidase__InfluenzaA__ADL29743

SEQ ID NO: 49833 - RNA, 1410 nt, Artificial Sequence
  neuraminidase__InfluenzaA__ADL29753
augaauccaaaccaaaagauaauaaccauugguucggucuguauggcaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacauuguggguuggucuuggccagacggugcugaguugccauuuaccauugacaaguaa

SEQ ID NO: 49834 - RNA, 1410 nt, Artificial Sequence; identical to SEQ ID NO: 48767
  neuraminidase__InfluenzaA__ADL29763

SEQ ID NO: 49835 - RNA, 1410 nt, Artificial Sequence; identical to SEQ ID NO: 49829
  neuraminidase__InfluenzaA__ADL29773

SEQ ID NO: 49836 - RNA, 1410 nt, Artificial Sequence; identical to SEQ ID NO: 48608
  neuraminidase__InfluenzaA__ADL29783

SEQ ID NO: 49837 - RNA, 1410 nt, Artificial Sequence; identical to SEQ ID NO: 49829
  neuraminidase__InfluenzaA__ADL29882

SEQ ID NO: 49838 - RNA, 1410 nt, Artificial Sequence
  neuraminidase__InfluenzaA__ADL32020
augaauccaaaccaaaagauaauaaccauugguucggucuguaugacaauuggaauggcuaacuuaauauuacaaauuggaaacauaaucucaacauggauuagccacucaauucaacuugggaaucaaaaucagauugaaacaugcaaucaaagcgucauuacuuaugaaaacaacacuuggguaaaucagacauauguuaacaucagcaacaccaacuuugcugcugggcagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacucuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49839 - RNA, 1410 nt, Artificial Sequence; identical to SEQ ID NO: 49829
  neuraminidase__InfluenzaA__ADL32030

SEQ ID NO: 49840 - RNA, 1410 nt, Artificial Sequence; identical to SEQ ID NO: 49496
  neuraminidase__InfluenzaA__ADL32040

SEQ ID NO: 49841 - RNA, 1410 nt, Artificial Sequence; identical to SEQ ID NO: 47242
  neuraminidase__InfluenzaA__ADL32050

SEQ ID NO: 49842 - RNA, 1410 nt, Artificial Sequence
  neuraminidase__InfluenzaA__ADL32060
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcaggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49843 - RNA, 1410 nt, Artificial Sequence; identical to SEQ ID NO: 47242
  neuraminidase__InfluenzaA__ADL32093

SEQ ID NO: 49844 - RNA, 1410 nt, Artificial Sequence; identical to SEQ ID NO: 49496
  neuraminidase__InfluenzaA__ADL32117

SEQ ID NO: 49845 - RNA, 1410 nt, Artificial Sequence
  neuraminidase__InfluenzaA__ADL32347
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguuccuucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49846 - RNA, 1410 nt, Artificial Sequence
  neuraminidase__InfluenzaA__ADL32357
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgccuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccguugacaaguaa

SEQ ID NO: 49847 - RNA, 1410 nt, Artificial Sequence; identical to SEQ ID NO: 48608
  neuraminidase__InfluenzaA__ADL32367

SEQ ID NO: 49848 - RNA, 1410 nt, Artificial Sequence; identical to SEQ ID NO: 48728
  neuraminidase__InfluenzaA__ADL32377

SEQ ID NO: 49849 - RNA, 1410 nt, Artificial Sequence; identical to SEQ ID NO: 47242
  neuraminidase__InfluenzaA__ADL32387

SEQ ID NO: 49850 - RNA, 1410 nt, Artificial Sequence; identical to SEQ ID NO: 48608
  neuraminidase__InfluenzaA__ADL32397

SEQ ID NO: 49851 - RNA, 1410 nt, Artificial Sequence; identical to SEQ ID NO: 48728
  neuraminidase__InfluenzaA__ADL32407

SEQ ID NO: 49852 - RNA, 1410 nt, Artificial Sequence; identical to SEQ ID NO: 47707
  neuraminidase__InfluenzaA__ADL32417

SEQ ID NO: 49853 - RNA, 1410 nt, Artificial Sequence
  neuraminidase__InfluenzaA__ADL32427
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaaaacaaucuggacuagcgggagcaucauauccuuuugugguguaaacagugacacuguggguuggucuuggccggacggugcugaguugccauuuaccauugacaaguaa

SEQ ID NO: 49854 - RNA, 1410 nt, Artificial Sequence
  neuraminidase__InfluenzaA__ADL32447
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccagugucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 49855 - RNA, 1410 nt, Artificial Sequence
  neuraminidase__InfluenzaA__ADL32457
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaagaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaguuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggcaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaagcagugacacuguggguuggucuuggccagacggugcugaguugccauuuaccauugacaaguaa

SEQ ID NO: 49856 - RNA, 1410 nt, Artificial Sequence; identical to SEQ ID NO: 49610
  neuraminidase__InfluenzaA__ADL32487

SEQ ID NO: 49857 - RNA, 1410 nt, Artificial Sequence
  neuraminidase__InfluenzaA__ADL32497
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacaaucagugguuuccgugaaauuagcgggcaauuccucucucugcccuguuaguggaugggcuauauacaguaaagacaacaguauaagaaucgguuccaagggggacguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49858 - RNA, 1410 nt, Artificial Sequence
  neuraminidase__InfluenzaA__ADL32507
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaaaacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 49859 - RNA, 1410 nt, Artificial Sequence; identical to SEQ ID NO: 49211
  neuraminidase__InfluenzaA__ADL32517

SEQ ID NO: 49860 - RNA, 1410 nt, Artificial Sequence
  neuraminidase__InfluenzaA__ADL32527
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucggcuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaaauucucaauaaagcaagauaucguaggaauaaaugaguggucaggguauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49861 - RNA, 1410 nt, Artificial Sequence
  neuraminidase__InfluenzaA__ADL32537
augaauccaaaccaaaagauaauaaccauugguucggucuguaugacuauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaucagaaucuggaauaucagauaggauacauaugcagugggauuuucggagacaauccacgcccuaaugauaaaacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49862 - RNA, 1410 nt, Artificial Sequence
  neuraminidase__InfluenzaA__ADL32547
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 49863 - RNA, 1410 nt, Artificial Sequence; identical to SEQ ID NO: 48668
  neuraminidase__InfluenzaA__ADL32673

SEQ ID NO: 49864 - RNA, 1410 nt, Artificial Sequence
  neuraminidase__InfluenzaA__ADL32683
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuaccuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggagcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagaggacgacccaaagagaacacaaucuggacuagcgggagcagcauauccuuuugugguguaaacagugacacuguggguuggucuuggccagacggugcugaguugccauuuaccauugacaaguaa

SEQ ID NO: 49865 - RNA, 1410 nt, Artificial Sequence; identical to SEQ ID NO: 47241
  neuraminidase__InfluenzaA__ADL32693

SEQ ID NO: 49866 - RNA, 1410 nt, Artificial Sequence
  neuraminidase__InfluenzaA__ADL32703
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagugggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggaggacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49867 - RNA, 1410 nt, Artificial Sequence; identical to SEQ ID NO: 47241
  neuraminidase__InfluenzaA__ADL32713

SEQ ID NO: 49868 - RNA, 1410 nt, Artificial Sequence
  neuraminidase__InfluenzaA__ADL32723
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguuugcagggauaacuggcauggcucgaaucggccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49869 - RNA, 1410 nt, Artificial Sequence; identical to SEQ ID NO: 48923
  neuraminidase__InfluenzaA__ADL32733

SEQ ID NO: 49870 - RNA, 1410 nt, Artificial Sequence
  neuraminidase__InfluenzaA__ADL32743
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcguaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccuaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49871 - RNA, 1410 nt, Artificial Sequence
  neuraminidase__InfluenzaA__ADL39139
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugagugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugagaggaccccuuaucggacccuauugaugaaugaguuagguguuccuuuucaucuggggaccaagcaagugugcauagcaugguccagcucaaguugucacgauggaaaagcauggcugcauguuuguauaacuggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaagagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucgaugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49872 - RNA, 1413 nt, Artificial Sequence
  neuraminidase__InfluenzaA__ADL39150
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucgaaucgaccuugggugucuuuuaaucaaaauuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucacuauugacaaguag

SEQ ID NO: 49873 - RNA, 1410 nt, Artificial Sequence
  neuraminidase__InfluenzaA__ADL39172
augaauccaaaucaaaagauaauaacuauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggagaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauuguuuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucaggcacauauggaacaggcucauggccugauggggcggacaucaaucucaugccuauauaa

SEQ ID NO: 49874 - RNA, 1410 nt, Artificial Sequence
  neuraminidase__InfluenzaA__ADL39183
augaauccaaaucaaaagauaauaacgauuggcucuguuucucucaccauuuccacaauaugcuucuucaugcaaauugccaucuugauaacuacuguaacauugcauuucaagcaauaugaauucaacuccccuccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccguuuuccaaggacaauucgauuaggcuuuccgcugguggggacaucuggguaacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuugggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49875 - RNA, 1413 nt, Artificial Sequence
  neuraminidase__InfluenzaA__ADL39194
augaacccaaaucaaaagauaauaaccauuggaucaaucaguauagcaaucggaauaauuagucuaauguugcaaauaggaaguauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguagauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguggcaauaacugauuggucaggguacagcggaaguuucguccaacauccugaauugacaggauuggacuguauaagaccuugcuucuggguugaguuagucagagggcugccuagagaaaauacaacaaucuggacuagugggagcaguauuucuuuuuguggcguuaauagugauacugcaaacuggucuuggccagacggugcugaguugccguucaccauugacaaguag

SEQ ID NO: 49876 - RNA, 1410 nt, Artificial Sequence; identical to SEQ ID NO: 49719
  neuraminidase__InfluenzaA__ADL39205

SEQ ID NO: 49877 - RNA, 1413 nt, Artificial Sequence; identical to SEQ ID NO: 48416
  neuraminidase__InfluenzaA__ADL39227

SEQ ID NO: 49878 - RNA, 1413 nt, Artificial Sequence
  neuraminidase__InfluenzaA__ADL39238
augaacccaaaucaaaagauaauaaccauuggaucaaucaguauagcaaucggaauaauuagucuaauguugcaaauaggaaguauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaauucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguagauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaauugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 49879 - RNA, 1413 nt, Artificial Sequence
  neuraminidase__InfluenzaA__ADL39249
augaacccaaaucaaaagauaauaaccauuggaucaaucaguauagcaaucggaauaauuagucuaauguugcaaauaggaaguauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguagauggagcaaacggagugaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaauugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 49880 - RNA, 1413 nt, Artificial Sequence
  neuraminidase__InfluenzaA__ADL39260
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucugcaugaacgggucauguuucaccauaaugaccgauggcccgaguaauaaggccgccucguacaaaauuuucaagauugaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguauuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 49881 - RNA, 1410 nt, Artificial Sequence
  neuraminidase__InfluenzaA__ADL39282
augaauccaaaucaaaagauaauaacgauuggcucuguuucucucaccauuuccacaauaugcuucuucaugcaaauugccaucuugauaacuacuguaacauugcauuucaagcaauaugaauucaacuccccuccaaacaaccaagugaugcugugugaaccaacaauaauagaaaaaaacauaacagagauaguguaucugaccaacaccaccauagagaaggaaauaugccccagacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacaaaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuugggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49882 - RNA, 1413 nt, Artificial Sequence
  neuraminidase__InfluenzaA__ADL39293
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgacccugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuuguuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 49883 - RNA, 1410 nt, Artificial Sequence
  neuraminidase__InfluenzaA__ADL39304
augaauccaaaucaaaagauaauaacgauuggcucuguuucucucaccauuuccacaauaugcuucuucaugcaaauugccaucuugauaacuacuguaacauugcauuucaagcaauaugaauuuaacuuccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaggaaauccucaggacccaggagucagaaugcguuuguaucaauggaacuuguacaguaguaaugacugaugggagugcuucaggaaaagcugauacuaaaauacuauucauugaggaggggaaaaucguucauaccagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugaugggaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49884 - RNA, 1410 nt, Artificial Sequence
  neuraminidase__InfluenzaA__ADL39326
augaauccaaaucaaaagauaauaacgauuggcucuguuucucucaccauuuccacaauaugcuucuucaugcaaauugccaucuugauaacuacugugacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccguuuuccaaggacaauucgauuaggcuuuccgcugguggggacaucuggguaacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49885 - RNA, 1413 nt, Artificial Sequence
  neuraminidase__InfluenzaA__ADL39392
augaacccaaaucaaaagauaauaaccauuggaucaaucaguauagcaaucggaauaauuagucuaauguugcaaauaggaaguauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuagccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguagauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaauugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 49886 - RNA, 1410 nt, Artificial Sequence
  neuraminidase__InfluenzaA__ADL39403
augaauccaaaucaaaagauaauaacgauuggcucuguuucucucaccauuuccacaauaugcuucuucaugcaaauugccaucuugauaacuacuguaacauugcauuucaagcaauaugaauucaacccccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcgucuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaaccauaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 49887 - RNA, 1413 nt, Artificial Sequence
  neuraminidase__InfluenzaA__ADL39425
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaauggaauaauaaccggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauagggagaaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 49888 - RNA, 1413 nt, Artificial Sequence
  neuraminidase__InfluenzaA__ADL39447
augaacccaaaucaaaagauaauaaccauuggaucaaucaguauagcaaucggaauaauuagucuaauguugcaaauaggaaguauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauugaccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 49889 - RNA, 1413 nt, Artificial Sequence
  neuraminidase__InfluenzaA__ADL39458
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccacgucccgaagauggagagggcagcugcaauccagugacuguugauggagcaaacggaguaaaaggguuuucauacaaauaugguaaugguguuuggauagggagaaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 49890 - RNA, 1413 nt, Artificial Sequence
  neuraminidase__InfluenzaA__ADL39469
augaacccaaaucaaaagauaauaaccauuggaucaaucaguauagcaaucggaauaauuagucuaauguugcaaauaggaaguauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguuggaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguagauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucugugaaacaggauguuguagcaauaacugauuggucaggguacagcggaaguuucguccaacauccugaauugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 49891 - RNA, 1413 nt, Artificial Sequence
  neuraminidase__InfluenzaA__ADL39480
augaacccaaaucaaaagauaauaaccauuggaucaaucaguauagcaaucggaauaauuagucuaauguugcaaauaggaaguauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggguacaucugcaguggaguguuuggugacaauccgcgucccgaagauggagagggcagcugcaauccagugacuguagauggagcaaacggaguaaaaggguuuucauacaaauaugguaaugguguuuggauaggaaggaccaaaaguaacagacuuagaaagggguuugagaugguuugggauccuaauggauggacaaauaccgacagugauuucucagugaaacaggauguuguagcaauaacugauuggucaggguacagcggaaguuucguccaacauccugaauugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 49892 - RNA, 1410 nt, Artificial Sequence
  neuraminidase__InfluenzaA__ADL39491
augaauccaaaucaaaagauaauaacgauuggcucuguuucucucaccauuuccacaauaugcuucuucaugcaaauugccaucuugauaacuacuguaacauugcauuucaagcaauaugaguucaacuccuccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacauaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaguguuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaaggacgauaagcgagaagucacgcuuaggguaugaaacuuucaaagucauugaaggcugguccaauccuaaauccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaagcaguauuguuguguuuuguggcaccucagguacauauggaacaggcucauggccugauggggcggacaucaaucuuaugccuauauaa

SEQ ID NO: 49893 - RNA, 1410 nt, Artificial Sequence; identical to SEQ ID NO: 47439
  neuraminidase__InfluenzaA__ADL41165

SEQ ID NO: 49894 - RNA, 1410 nt, Artificial Sequence
  neuraminidase__InfluenzaA__ADL41175
augaauccaaaccaaaagauaauaaccauugguucggucuguaugacaauuggaauggcuaacuuaauauuacaaauuggaaacauaaucucaacauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacagcguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaaaauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49895 - RNA, 1413 nt, Artificial Sequence
  neuraminidase__InfluenzaA__ADL60255
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaauuacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccaaagauggaaggggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacgaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 49896 - RNA, 1413 nt, Artificial Sequence
  neuraminidase__InfluenzaA__ADL60277
augaacccaaaucaaaggauaauaaccauuggaucaaucaguauagcaaucggaauaauuagucuaauguugcaaauaggaaauauuauuucaauaugggcuagucacucaauccaaauuggaagucaaaacaacacuggaauaugcaaccaaagaaucaucacauaugaaaacagcaccugggugaaucauacauauguuaauauuaacaacacuaauguuguugcuggagaggacaaaacgccagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccgcaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuauccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 49897 - RNA, 1413 nt, Artificial Sequence
  neuraminidase__InfluenzaA__ADL60288
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccaaagauggaaagggcagcugcaauccagugacuguugauggagcaaacggaguaaaaggguuuucauacaaauaugguaaugggguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 49898 - RNA, 1413 nt, Artificial Sequence
  neuraminidase__InfluenzaA__ADL60299
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaguauuaacaacacuaauguuguugcuggaaaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaagacuuggauuaucaaauaggauacaucugcaguggaguguuuggugacaauccccgucccaaagauggaaagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 49899 - RNA, 1413 nt, Artificial Sequence
  neuraminidase__InfluenzaA__ADL60310
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggcuggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuucaaucaaaacuuggauuaucaaauaggauacaucugcaguggaguguucggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccauucaccauugacaaguag

SEQ ID NO: 49900 - RNA, 1413 nt, Artificial Sequence
  neuraminidase__InfluenzaA__ADL60321
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauggugauguguguaugcagggacaacuggcaugguucaaaucgaccuugggugucuuuuaaucaaaacuuggauuaucaaauaggauacaucugcaguggaguguucggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugaucugggauccuaauggauggacaaauaccgacagugauuucucagugaaacaggauguuguagcaauaacugauuggucaggauacagcggaaguuucguccaacauccugaguuaacaggauuggacuguauaagaccuugcuucuggguugaguuagucagagggcugccuagagaaaauacaacaaucuggacuagugggagcagcauuuccuuuuguggcguuaauagugauacugcaaacuggucuuggccagacggugcugaguugccguucaccauugacaaguag

SEQ ID NO: 49901 - RNA, 1413 nt, Artificial Sequence
  neuraminidase__InfluenzaA__ADL60332
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguucggugacaauccgcgucccaaagauggaaggggcagcugcaauccagugacuguugauggagcaaacggaguaaaaggguuuucauacaaauaugauaaugguguuuggauaggaaggaccaaaaguaacagacuuagaaagggguuugagaugaucugggauccuaauggauggacaaauaccgacagugauuucucagugaaacaggauguuguagcaauaacugauuggucaggauacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 49902 - RNA, 1413 nt, Artificial Sequence
  neuraminidase__InfluenzaA__ADL60343
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacguaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaacaauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguucggugacaauccgcgucccgaagauggagagggcagcugcaauccagugacuguugauggagcaaacggaguaaaaggguuuucauauaaauaugauaaugguguuuggauaggaaggaccaaaaguaacagacuuagaaagggguuugagaugaucugggauccuaauggauggacaaauaccgacagugauuucucagugaaacaggauguuguagcaauaacugauuggucaggauacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 49903 - RNA, 1413 nt, Artificial Sequence
  neuraminidase__InfluenzaA__ADL60354
augaacccaaaucaaaggauaauaaccauuggaucaaucaguauagcaaucggaauaauuagucuaauguugcaaauaggaaauauuauuucaauaugggcuagucacucaauccaaauuggaagucaaaacaacacuggaauaugcaaccaaagaaucaucacauaugaaaacagcaccugggugaaucauacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccgcaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccaaagauggaaagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaauuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 49904 - RNA, 1410 nt, Artificial Sequence
  neuraminidase__InfluenzaA__ADL60365
augaauccaaaucaaaagauaauaacgauuggcucuguuucucucaccauuuccacaauaugcuucuucaugcaaauugccaucuugauaacuacuguaacauugcauuucaagcaauaugaauucaacuccuccccaaacaaccaagugaugcugugugaaccaacaauaauagaaagaaacauaacagagauaguguaucugaccaacaccaccauagagaaggaaauaagccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacauaguacgugauaggaccccuuaucggacccuauugaugaaugaguuagguguuccuuuucaucuggggaccaagcaagucugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcacuguuuccaguuauguguguucaggacuuguuggagacacacccagaaaaaacgacagcuccagcaguagccauuguuuggauccuaacaaugaagaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49905 - RNA, 1413 nt, Artificial Sequence
  neuraminidase__InfluenzaA__ADL60376
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccggaaaggacagaaguccuuauagggccuuaaugagcuguccucuaggugaagcuccguccccauacaauucaaaguucgaaucgguugcauggucagcaagcgcaugccaugauggcaugggcugguuaacaaucggaauuucugguccagacaauggagcuguggcugugcuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccaaagauggaaagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 49906 - RNA, 1410 nt, Artificial Sequence; identical to SEQ ID NO: 47242
  neuraminidase__InfluenzaA__ADM07137

SEQ ID NO: 49907 - RNA, 1410 nt, Artificial Sequence; identical to SEQ ID NO: 47242
  neuraminidase__InfluenzaA__ADM07146

SEQ ID NO: 49908 - RNA, 1410 nt, Artificial Sequence; identical to SEQ ID NO: 47242
  neuraminidase__InfluenzaA__ADM07156

SEQ ID NO: 49909 - RNA, 1410 nt, Artificial Sequence; identical to SEQ ID NO: 47242
  neuraminidase__InfluenzaA__ADM07165

SEQ ID NO: 49910 - RNA, 1413 nt, Artificial Sequence
  neuraminidase__InfluenzaA__ADM07474
augaacccaaaucaaaagauaauaaccauuggaucaaucaguauagcaaucggaauaauuagucuaauguuacaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuugaugagcuguccucuaggugaagcuccguccccauacaauucaaaguucgaaucaguugcauggucagcaagcgcaugccaugauggcaugggcugguuaacaauaggaauuucugguccagacaauggagcuguggcuguacuaaaauacaacggaauaauaacugggaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 49911 - RNA, 1413 nt, Artificial Sequence
  neuraminidase__InfluenzaA__ADM07485
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcaucagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauuaugacugauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggacuaucagauaggauacaucugcaguggaguguuuggugacaauccgcgucccgaagauggagagggcagcugcaauccagugacuguugauggagcaaauggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 49912 - RNA, 1410 nt, Artificial Sequence
  neuraminidase__InfluenzaA__ADM07496
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaauauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuuuauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaauaucaugccuauauaa

SEQ ID NO: 49913 - RNA, 1410 nt, Artificial Sequence
  neuraminidase__InfluenzaA__ADM07507
augaauccaaaucaaaagauaauaacgauuggcucuguuucucucaccauuuccacaauaugcuucuuuaugcaaaccgccauccugauaacuacuguaacauugcauuucaagcaauuugaauucaacucccccccaaacaaccaagugaugcugugugaaccagcaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucuugcgauccagacaaguguuaucaauuugcccuuggacagggaacaacacuaaacaacgugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaaaucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaaggaaagaggaaaccgaagucuuguggaccucaaacaguauuguuguguuuuguggcaccucagguacauauggaacaggcucauggccugauggggcggacaucaaucucaugccuauauaa

SEQ ID NO: 49914 - RNA, 1410 nt, Artificial Sequence
  neuraminidase__InfluenzaA__ADM12820
augaauccaaaucaaaagauaauaacgauuggcucuguuucucucaccauuuccacaauaugcuucuucaugcaaauugccaucuugauaacuacuguaacauugcauuucaagcaauauaaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaaugugacauuacgggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucgaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaauuguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 49915 - RNA, 1410 nt, Artificial Sequence; identical to SEQ ID NO: 49914
  neuraminidase__InfluenzaA__ADM12831

SEQ ID NO: 49916 - RNA, 1410 nt, Artificial Sequence
  neuraminidase__InfluenzaA__ADM12842
augaauccaaaucaaaagauaauaacgauuggcucuguuucucucaccauuuccacaauaugcuucuucaugcaaauugccaucuugauaacuacuguaacauugcauuucaagcaauauaaauucaacucccccccaaacaaccaagugaugcugugugaaccaacaauaauagaaagaaacauaacagagauaguguaucugaccaauaccaccauagagaaggaaauaugccccaaacuagcagaauacagaaauuggucaaaaccgcaaugugacauuacgggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucgaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaauuguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 49917 - RNA, 1410 nt, Artificial Sequence
  neuraminidase__InfluenzaA__ADM12853
augaauccaaaucaaaagauaauaacgauuggcucuguuucucucaccauuuccacaauaugcuucuucaugcaaauugccaucuugauaacuacuguaacauugcauuucaagcaauauaaauucaacucccccccaaacaaccaagugaugcugugugaaccaacaauaauagagagaaacauaacagagauaguguaucugaccaacaccaccauagagaaggaaauaugccccaaacuagcagaauacagaaauuggucaaaaccgcaaugugacauuacgggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucgaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaauuguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 49918 - RNA, 1410 nt, Artificial Sequence
  neuraminidase__InfluenzaA__ADM12864
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauucuaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaauggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49919 - RNA, 1410 nt, Artificial Sequence; identical to SEQ ID NO: 49496
  neuraminidase__InfluenzaA__ADM12874

SEQ ID NO: 49920 - RNA, 1410 nt, Artificial Sequence
  neuraminidase__InfluenzaA__ADM12884
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauucuaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggaucuucggagacaauccacgcccuaaugauaagacaggcaguugugguccaguaucgucuaauggagcaaauggaguaaaaggauuuucauucaaauacggcaaugguguuuggauaggaagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49921 - RNA, 1410 nt, Artificial Sequence
  neuraminidase__InfluenzaA__ADM12894
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaguccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49922 - RNA, 1410 nt, Artificial Sequence; identical to SEQ ID NO: 47242
  neuraminidase__InfluenzaA__ADM12904

SEQ ID NO: 49923 - RNA, 1410 nt, Artificial Sequence
  neuraminidase__InfluenzaA__ADM12914
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugacaagacaggcaguugugguccaguaucgucuuauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaggauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcggaagcagcauauccuuuugugguguaaacagugacacuguggguuggucuuggccagacggugcugaguugccauuuaccauugacaaguaa

SEQ ID NO: 49924 - RNA, 1410 nt, Artificial Sequence; identical to SEQ ID NO: 47242
  neuraminidase__InfluenzaA__ADM12924

SEQ ID NO: 49925 - RNA, 1410 nt, Artificial Sequence; identical to SEQ ID NO: 47242
  neuraminidase__InfluenzaA__ADM12934

SEQ ID NO: 49926 - RNA, 1410 nt, Artificial Sequence; identical to SEQ ID NO: 47242
  neuraminidase__InfluenzaA__ADM12944

SEQ ID NO: 49927 - RNA, 1410 nt, Artificial Sequence; identical to SEQ ID NO: 47242
  neuraminidase__InfluenzaA__ADM12954

SEQ ID NO: 49928 - RNA, 1410 nt, Artificial Sequence; identical to SEQ ID NO: 48796
  neuraminidase__InfluenzaA__ADM12964

SEQ ID NO: 49929 - RNA, 1410 nt, Artificial Sequence
  neuraminidase__InfluenzaA__ADM12974
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucaguaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49930 - RNA, 1410 nt, Artificial Sequence
  neuraminidase__InfluenzaA__ADM12984
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauacgggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaggaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49931 - RNA, 1410 nt, Artificial Sequence; identical to SEQ ID NO: 47707
  neuraminidase__InfluenzaA__ADM12994

SEQ ID NO: 49932 - RNA, 1410 nt, Artificial Sequence; identical to SEQ ID NO: 47707
  neuraminidase__InfluenzaA__ADM13004

SEQ ID NO: 49933 - RNA, 1410 nt, Artificial Sequence
  neuraminidase__InfluenzaA__ADM13014
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugaugguaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49934 - RNA, 1410 nt, Artificial Sequence
  neuraminidase__InfluenzaA__ADM13034
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccaucaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaauugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49935 - RNA, 1410 nt, Artificial Sequence
  neuraminidase__InfluenzaA__ADM13044
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcaucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucguccaauggagcaaauggaguaaaaggauuuucauucaaauacggcaaugguguuuggauagggagaacuaaaagcauuaguucaagaaacgguuuugagaugauuugggauccgaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49936 - RNA, 1410 nt, Artificial Sequence
  neuraminidase__InfluenzaA__ADM13054
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccaaacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49937 - RNA, 1410 nt, Artificial Sequence; identical to SEQ ID NO: 49610
  neuraminidase__InfluenzaA__ADM13064

SEQ ID NO: 49938 - RNA, 1410 nt, Artificial Sequence
  neuraminidase__InfluenzaA__ADM13074
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuagcugcuggacagucagugguuuccgugaaauuagcgggcaauuccucucucugcccuguuaguggaugggcuauauacaguaaagacaacaguauaagaaucggcuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaaauucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49939 - RNA, 1410 nt, Artificial Sequence
  neuraminidase__InfluenzaA__ADM13084
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucggcuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacugugaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaaauucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauaucauuuugugguguaaacagugacacuguggguuggucuuggccagacggugcugaguugccauuuaccauugacaaguaa

SEQ ID NO: 49940 - RNA, 1410 nt, Artificial Sequence
  neuraminidase__InfluenzaA__ADM13094
augaauccaaaccaaaagauaauaaccauugguucggucuguaugacaauuggaauggcuaacuuaauauuacaaauuggaaacacaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgcgaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 49941 - RNA, 1410 nt, Artificial Sequence; identical to SEQ ID NO: 49212
  neuraminidase__InfluenzaA__ADM13104

SEQ ID NO: 49942 - RNA, 1410 nt, Artificial Sequence
  neuraminidase__InfluenzaA__ADM13124
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggagccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaaaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaugguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 49943 - RNA, 1410 nt, Artificial Sequence
  neuraminidase__InfluenzaA__ADM13134
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucaguaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagagaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauacauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49944 - RNA, 1410 nt, Artificial Sequence
  neuraminidase__InfluenzaA__ADM13154
augaauccaaaccaaaagauaauaaccauugguucggucuguaugacaauuggaauggcuaacuuaauauuacaaauuggaaacauaaucucaauauggauuagccacucaauucaacuugggaaucaaaagcagauugaaacaugcaaucaaagcgucuuuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaaaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacuggaacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49945 - RNA, 1410 nt, Artificial Sequence
  neuraminidase__InfluenzaA__ADM13164
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccaggaucuggaauaucagauaggauacauaugcagugggauuuucggagacaauccacgcccuaaugauaagacaggcaguuguggcccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49946 - RNA, 1410 nt, Artificial Sequence; identical to SEQ ID NO: 47439
  neuraminidase__InfluenzaA__ADM13174

SEQ ID NO: 49947 - RNA, 1410 nt, Artificial Sequence; identical to SEQ ID NO: 47439
  neuraminidase__InfluenzaA__ADM13184

SEQ ID NO: 49948 - RNA, 1410 nt, Artificial Sequence
  neuraminidase__InfluenzaA__ADM13194
augaauccaaaccaaaagauaauaaccauugguucggucuguaugacaauuggaauggcuaacuuaauauuacaaauuggaaacauaaucucaauauggauuagccacucaauucaacuugggaaucaaaaucaaauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 49949 - RNA, 1410 nt, Artificial Sequence
  neuraminidase__InfluenzaA__ADM13204
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguuuuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggacaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 49950 - RNA, 1410 nt, Artificial Sequence
  neuraminidase__InfluenzaA__ADM13214
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucggcuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaaauucucaauaaagcaagauaucguaggaauaaaugaguggucaggauauagcgggaguuuuguucagcauccagaacuaacagggcuggauuguauaagaccuugcuucuggguugaacuaaucagggggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49951 - RNA, 1410 nt, Artificial Sequence
  neuraminidase__InfluenzaA__ADM13224
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacugacacuaucaggaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuaguaaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgaccaaaagagaacacaaucuggacuagcgggagcagcauauccuuuugugguguaaacagugacacuguggguuggucuuggccagacggugcugaguugccauuuaccauugacaaguaa

SEQ ID NO: 49952 - RNA, 1410 nt, Artificial Sequence; identical to SEQ ID NO: 49219
  neuraminidase__InfluenzaA__ADM13234

SEQ ID NO: 49953 - RNA, 1410 nt, Artificial Sequence
  neuraminidase__InfluenzaA__ADM13244
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucaguaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacuggaacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49954 - RNA, 1410 nt, Artificial Sequence; identical to SEQ ID NO: 48517
  neuraminidase__InfluenzaA__ADM13254

SEQ ID NO: 49955 - RNA, 1410 nt, Artificial Sequence
  neuraminidase__InfluenzaA__ADM13264
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucggcuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacugugaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaaauucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49956 - RNA, 1410 nt, Artificial Sequence; identical to SEQ ID NO: 48286
  neuraminidase__InfluenzaA__ADM13274

SEQ ID NO: 49957 - RNA, 1410 nt, Artificial Sequence; identical to SEQ ID NO: 49219
  neuraminidase__InfluenzaA__ADM13284

SEQ ID NO: 49958 - RNA, 1410 nt, Artificial Sequence
  neuraminidase__InfluenzaA__ADM13294
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgagcccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaauguuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauagcuucucaauaaaacaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49959 - RNA, 1410 nt, Artificial Sequence; identical to SEQ ID NO: 48035
  neuraminidase__InfluenzaA__ADM13304

SEQ ID NO: 49960 - RNA, 1410 nt, Artificial Sequence
  neuraminidase__InfluenzaA__ADM13314
augaauccaaaccaaaagauaauaaccauugguucggucuguaugacaauuggaauggcuaacuuaauauuacaaaucggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggacaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49961 - RNA, 1410 nt, Artificial Sequence
  neuraminidase__InfluenzaA__ADM13324
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacuggaacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49962 - RNA, 1410 nt, Artificial Sequence
  neuraminidase__InfluenzaA__ADM13344
augaauccaaaccaaaagauaauaaucauugguucggucuguaugacaauuggaauggcuaacuuaauauuacaaauuggaaacauaaucucaauauggauucuccacucaauucaacuugggaaucaaaaucagauugaaacaugcaaucaaagcgucauuacuuaugaaaacaacacuuggguaaaucaaacauauguuaacaucagcaacaccaacuuugcugcuggacagucagugguuuccgugaaauuagcaggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucgcaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49963 - RNA, 1410 nt, Artificial Sequence
  neuraminidase__InfluenzaA__ADM13354
augaauccaaaccaaaagauaauaaccauugguucggucuguaugacaauuggaauggcuaacuuaauauuacaaauugggaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggagccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaaaauagaaaagggaaagauagucaaaucagucgaaaugaaugcuccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaugguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggagacccaaagagaacacaaucuggacuagcgggagcagcauauccuuuugugguguaaacagugacacuguggguuggucuuggccggacggugcugaguugccauuuaccauugacaaguaa

SEQ ID NO: 49964 - RNA, 1410 nt, Artificial Sequence; identical to SEQ ID NO: 49212
  neuraminidase__InfluenzaA__ADM13363

SEQ ID NO: 49965 - RNA, 1410 nt, Artificial Sequence
  neuraminidase__InfluenzaA__ADM13464
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgaucauggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacugggaaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaagggaacaggagacuagagugugguggaccucaaacaguauuguuguguuuuguggcacuucagguaccuauggaacaggcucauggccugauggggcgaacaucaauuucaugccuauauaa

SEQ ID NO: 49966 - RNA, 1410 nt, Artificial Sequence
  neuraminidase__InfluenzaA__ADM13465
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgaucauggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugaugaggggaaggaaacaggagacuagagugugguggaccucaaacaguauuguuguguuuuguggcacuucagguaccuauggaacaggcucauggccugauggggcgaacaucaauuucaugccuauauaa

SEQ ID NO: 49967 - RNA, 1410 nt, Artificial Sequence; identical to SEQ ID NO: 47710
  neuraminidase__InfluenzaA__ADM13466

SEQ ID NO: 49968 - RNA, 1410 nt, Artificial Sequence
  neuraminidase__InfluenzaA__ADM13467
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucuucugguggggacauuugggugacgagagaaccuuaugugucaugcgaucauggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagagugugguggaccucaaacaguauuguuguguuuuguggcacuucagguaccuauggaacaggcucauggccugauggggcgaacaucaauuucaugccuauauaa

SEQ ID NO: 49969 - RNA, 1410 nt, Artificial Sequence; identical to SEQ ID NO: 44599
  neuraminidase__InfluenzaA__ADM13468

SEQ ID NO: 49970 - RNA, 1410 nt, Artificial Sequence
  neuraminidase__InfluenzaA__ADM13469
augaauccaaaucaaaagauaauaacaauuggcucugucucucucaccauugcaacagcaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuucucuaaggacaauucaauccggcuuucugcugguggggacauuugggugacgagagaaccuuaugugucaugcgaucauggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagagugugguggaccucaaacaguauuguuguguuuuguggcacuucagguaccuauggaacaggcucauggccugauggggcgaacaucaauuucaugccuauauaa

SEQ ID NO: 49971 - RNA, 1410 nt, Artificial Sequence
  neuraminidase__InfluenzaA__ADM13470
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgaucauggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaauugacagcgauaaucggucagguuacucugguauuuucucuguugagggcaaaagcugcaucaauaggugcuuuuauguggaguugauaaggggaaggaaacaggagacuagagugugguggaccucaaacaguauuguuguguuuuguggcacuucagguaccuauggaacaggcucauggccugauggggcgaacaucaauuucaugccuauauaa

SEQ ID NO: 49972 - RNA, 1410 nt, Artificial Sequence
  neuraminidase__InfluenzaA__ADM13471
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggauuucugcugguggggacauuugggugacgagagaaccuuaugugucaugcgaucauggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagagugugguggaccucaaacaguauuguuguguuuuguggcacuucagguaccuauggaacaggcucauggccugauggggcgaacaucaauuucaugccuauauaa

SEQ ID NO: 49973 - RNA, 1410 nt, Artificial Sequence; identical to SEQ ID NO: 47012
  neuraminidase__InfluenzaA__ADM13472

SEQ ID NO: 49974 - RNA, 1410 nt, Artificial Sequence; identical to SEQ ID NO: 44599
  neuraminidase__InfluenzaA__ADM13473

SEQ ID NO: 49975 - RNA, 1410 nt, Artificial Sequence; identical to SEQ ID NO: 47008
  neuraminidase__InfluenzaA__ADM13474

SEQ ID NO: 49976 - RNA, 1410 nt, Artificial Sequence
  neuraminidase__InfluenzaA__ADM14469
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguaugagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugcgguccaguaucgucuaauggagcaaauggaguaaaaggauuuucauucaaauacggcaaugguguuuggauagggagaacuaaaagcauuaguucaagaaccgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49977 - RNA, 1410 nt, Artificial Sequence; identical to SEQ ID NO: 47242
  neuraminidase__InfluenzaA__ADM14479

SEQ ID NO: 49978 - RNA, 1410 nt, Artificial Sequence; identical to SEQ ID NO: 47242
  neuraminidase__InfluenzaA__ADM14499

SEQ ID NO: 49979 - RNA, 1410 nt, Artificial Sequence; identical to SEQ ID NO: 48755
  neuraminidase__InfluenzaA__ADM14518

SEQ ID NO: 49980 - RNA, 1410 nt, Artificial Sequence
  neuraminidase__InfluenzaA__ADM14527
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucaguggccuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaccgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49981 - RNA, 1410 nt, Artificial Sequence
  neuraminidase__InfluenzaA__ADM14537
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauagcuucucaauaaagcaagauaucguaggaauaaaugaguggucaggauauagcgggagcuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49982 - RNA, 1410 nt, Artificial Sequence; identical to SEQ ID NO: 47620
  neuraminidase__InfluenzaA__ADM14546

SEQ ID NO: 49983 - RNA, 1410 nt, Artificial Sequence
  neuraminidase__InfluenzaA__ADM14555
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucagauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49984 - RNA, 1410 nt, Artificial Sequence; identical to SEQ ID NO: 47242
  neuraminidase__InfluenzaA__ADM14573

SEQ ID NO: 49985 - RNA, 1410 nt, Artificial Sequence
  neuraminidase__InfluenzaA__ADM14582
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcugaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagacaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguag

SEQ ID NO: 49986 - RNA, 1410 nt, Artificial Sequence
  neuraminidase__InfluenzaA__ADM14591
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcugaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49987 - RNA, 1410 nt, Artificial Sequence
  neuraminidase__InfluenzaA__ADM14601
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaauggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49988 - RNA, 1410 nt, Artificial Sequence
  neuraminidase__InfluenzaA__ADM14611
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuaucgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccugcuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49989 - RNA, 1410 nt, Artificial Sequence; identical to SEQ ID NO: 47242
  neuraminidase__InfluenzaA__ADM14620

SEQ ID NO: 49990 - RNA, 1410 nt, Artificial Sequence; identical to SEQ ID NO: 48286
  neuraminidase__InfluenzaA__ADM14629

SEQ ID NO: 49991 - RNA, 1410 nt, Artificial Sequence; identical to SEQ ID NO: 47242
  neuraminidase__InfluenzaA__ADM14639

SEQ ID NO: 49992 - RNA, 1410 nt, Artificial Sequence
  neuraminidase__InfluenzaA__ADM14657
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaagucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49993 - RNA, 1410 nt, Artificial Sequence
  neuraminidase__InfluenzaA__ADM14666
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucuuacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49994 - RNA, 1410 nt, Artificial Sequence; identical to SEQ ID NO: 47242
  neuraminidase__InfluenzaA__ADM14684

SEQ ID NO: 49995 - RNA, 1410 nt, Artificial Sequence
  neuraminidase__InfluenzaA__ADM14693
augaauccaaaccaaaagaugauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49996 - RNA, 1410 nt, Artificial Sequence
  neuraminidase__InfluenzaA__ADM14702
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccacuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaaaauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaauggugcuuggauagggagaacuaaaagcacuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49997 - RNA, 1410 nt, Artificial Sequence
  neuraminidase__InfluenzaA__ADM14711
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaaaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggggacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49998 - RNA, 1410 nt, Artificial Sequence
  neuraminidase__InfluenzaA__ADM14720
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49999 - RNA, 1410 nt, Artificial Sequence
  neuraminidase__InfluenzaA__ADM14730
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcaucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuguauacaguaaagacaacaguauaagaaucgguuccaagggggaugugcuugucauaagggaaccauucauaucaugcucccccuuggaaugcagaaccuucuucuugacucagggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagaaucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaagcgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50000 - RNA, 1350 nt, Artificial Sequence
  neuraminidase__InfluenzaA__ADM14748
augaauccaaaccaaaagauaauaaccauugguucgguuuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggucagucagugguuuccgugaaauuagcgggcaauuccucucucugcccugucaguggaugggcuauauacaguaaagacaacaguauaagaauaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaaaacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaacaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50001 - RNA, 1410 nt, Artificial Sequence
  neuraminidase__InfluenzaA__ADM14758
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaauaaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50002 - RNA, 1410 nt, Artificial Sequence; identical to SEQ ID NO: 50001
  neuraminidase__InfluenzaA__ADM14767

SEQ ID NO: 50003 - RNA, 1410 nt, Artificial Sequence; identical to SEQ ID NO: 47242
  neuraminidase__InfluenzaA__ADM14777

SEQ ID NO: 50004 - RNA, 1410 nt, Artificial Sequence; identical to SEQ ID NO: 47242
  neuraminidase__InfluenzaA__ADM14814

SEQ ID NO: 50005 - RNA, 1410 nt, Artificial Sequence; identical to SEQ ID NO: 47242
  neuraminidase__InfluenzaA__ADM14823

SEQ ID NO: 50006 - RNA, 1410 nt, Artificial Sequence
  neuraminidase__InfluenzaA__ADM14841
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaacaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50007 - RNA, 1410 nt, Artificial Sequence; identical to SEQ ID NO: 50006
  neuraminidase__InfluenzaA__ADM14859

SEQ ID NO: 50008 - RNA, 1410 nt, Artificial Sequence; identical to SEQ ID NO: 48379
  neuraminidase__InfluenzaA__ADM14868

SEQ ID NO: 50009 - RNA, 1410 nt, Artificial Sequence
  neuraminidase__InfluenzaA__ADM14878
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaacaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50010 - RNA, 1410 nt, Artificial Sequence; identical to SEQ ID NO: 47975
  neuraminidase__InfluenzaA__ADM14887

SEQ ID NO: 50011 - RNA, 1410 nt, Artificial Sequence
  neuraminidase__InfluenzaA__ADM14896
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggaugugcuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcaucuccuuuugugguguaaacagugacacuguggguuggucuuggccagacggugcugaguugccauuuaccauugacaaguaa

SEQ ID NO: 50012 - RNA, 1410 nt, Artificial Sequence; identical to SEQ ID NO: 47242
  neuraminidase__InfluenzaA__ADM14905

SEQ ID NO: 50013 - RNA, 1410 nt, Artificial Sequence
  neuraminidase__InfluenzaA__ADM14923
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucguucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50014 - RNA, 1410 nt, Artificial Sequence
  neuraminidase__InfluenzaA__ADM14932
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggguauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50015 - RNA, 1410 nt, Artificial Sequence
  neuraminidase__InfluenzaA__ADM14950
augaauccaaaccaaaagauaauaaccauugguucggucuguaugacaauuggaauggcuaacuuaauauuacaaauuggaaacauaaucucaauauggauuagccacucaauucaacuugggaaccaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaauuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50016 - RNA, 1410 nt, Artificial Sequence
  neuraminidase__InfluenzaA__ADM14959
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaaaaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcugaauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50017 - RNA, 1410 nt, Artificial Sequence
  neuraminidase__InfluenzaA__ADM14977
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaauggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50018 - RNA, 1410 nt, Artificial Sequence
  neuraminidase__InfluenzaA__ADM14987
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaacaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50019 - RNA, 1410 nt, Artificial Sequence; identical to SEQ ID NO: 49718
  neuraminidase__InfluenzaA__ADM26787

SEQ ID NO: 50020 - RNA, 1410 nt, Artificial Sequence
  neuraminidase__InfluenzaA__ADM26798
augaauccaaaucaaaagauaauaacgauuggcucuguuucucucaccauuuccacaauaugcuucuucaugcaaauugccaucuugguaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcuugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaggaggaaacugaagucuuguggaccucaaacaguauuguuguguuuuguggcaccucagguacauauggaacaggcucauggccugauggggcgaacaucaaucucaugccuauauaa

SEQ ID NO: 50021 - RNA, 1410 nt, Artificial Sequence
  neuraminidase__InfluenzaA__ADM26809
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacaguaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguggauaguguuguuucaugguccaaagaaauccucaggacccaggagucagaaugcgucuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaacuuucaaagucauugaaggcugguccaaccauaaguccaaauugcagauaaauaggcaggucauaguugacagagguaauagguccgguuauucugguauuuucucuguugaaggcaaaagcugcaucaaucggugcuuuuauguggaguugauuaggggaagaaaagaggaaacugaaguauuguggaccucaaacaguauuguuguguuuuguggcaccucagguacauauggaacaggcucauggccugauggggcggaccucaaucucaugccuauauaa

SEQ ID NO: 50022 - RNA, 1410 nt, Artificial Sequence
  neuraminidase__InfluenzaA__ADM26820
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcaagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaucucaaucucaugccuauauaa

SEQ ID NO: 50023 - RNA, 1350 nt, Artificial Sequence
  neuraminidase__InfluenzaA__ADM31427
augaauccaaaccagaagauaauaaccauuggaucagucuguaugauaauuggaauaguuagcuuaauguuacagauugggaacaugaucucaauaugggucagucauucaauucaaacagggaaucaacaccaagcugaaccaaucagaaauacuaauuuucuuacugagaacgcuguggcuucaguaacauuagcgggcaauucaucucuuugccccauuagaggaugggccguacacaguaaagacaacaguauaaggauuggguccaagggggauguguuuguaauuagggagccguucaucucaugcucccauauggaaugcaggacuuucuuuuugacucagggagccuuacugaaugacaagcauuccaacgggacugucaaagacaggagcccucacagaacacuaaugaguuguccugugggugaggcucccuccccauauaacucgagguuugagucuguugcuuggucagcaagcgcuugccaugauggcaucaguugguugacaauuggaauuucugguccagacaauggggcuguggcgguauugaaauacaauggcauaauaacagacacuaucaagaguugggggaauaacauacugaggacucaagagucugaaugugcauguguaaauggcucuugcuuuacuguaaugacagauggaccaaguaauggacaggcaucauauaagaucuucaaaauagaaaaagggaaaguaguuaaaucagucgaauugaaugcuccuaauuaucacuaugaggaaugcuccuguuauccugauucuggcgaaauaauaugugugugcagggacaauuggcauggcucaaauaggccaugggugucuuucaaucagaauuuggaguaucaaauaggauauauuugcagugggguuuucggagacaauccacggccaaaugaugggacagguaguugugguccaauguccccuaacggggcauaugggauaaaaggguuuucauuuaaauacgguaaugguguuuggaucgggagaaccaaaagcacuaauuccaggagcgguuuugaaaugauuugggauccaaauggguggacuggaacggacagugaauuuucggugaaacaagauauaguagcaauaacugauuggucaggauauagcgggaguuuuguccagcauccggaacugacaggauuagacugcauaagaccuugcuucuggguugaguuaaucagggggcggccaaaagaaagcacaauuuggacuagugggagcagcauaucuuuuugugguguaaauagugacacugugaguuggucuuggccagacggugcugaguugccauucaccauugacaaguaa

SEQ ID NO: 50024 - RNA, 1410 nt, Artificial Sequence
  neuraminidase__InfluenzaA__ADM31481
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaagggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 50025 - RNA, 1410 nt, Artificial Sequence
  neuraminidase__InfluenzaA__ADM31491
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauucuucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguuucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50026 - RNA, 1410 nt, Artificial Sequence
  neuraminidase__InfluenzaA__ADM31501
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcaucauauccuuuugugguguaaacagugacacuguggguuggucuuggccggacggugcugaguugccauuuaccauugacaaguaa

SEQ ID NO: 50027 - RNA, 1410 nt, Artificial Sequence
  neuraminidase__InfluenzaA__ADM31511
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaauaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuagaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 50028 - RNA, 1410 nt, Artificial Sequence
  neuraminidase__InfluenzaA__ADM31521
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaagugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50029 - RNA, 1410 nt, Artificial Sequence; identical to SEQ ID NO: 49068
  neuraminidase__InfluenzaA__ADM31531

SEQ ID NO: 50030 - RNA, 1410 nt, Artificial Sequence
  neuraminidase__InfluenzaA__ADM31541
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacaccuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauuucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacuggaacagacaauaacuucucaauaaagcaagauaucguaggaauaaaugaguggucaggguauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50031 - RNA, 1410 nt, Artificial Sequence
  neuraminidase__InfluenzaA__ADM31551
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauaugucaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagacaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50032 - RNA, 1410 nt, Artificial Sequence; identical to SEQ ID NO: 47439
  neuraminidase__InfluenzaA__ADM31561

SEQ ID NO: 50033 - RNA, 1410 nt, Artificial Sequence
  neuraminidase__InfluenzaA__ADM31571
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuucacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 50034 - RNA, 1410 nt, Artificial Sequence; identical to SEQ ID NO: 48419
  neuraminidase__InfluenzaA__ADM31581

SEQ ID NO: 50035 - RNA, 1410 nt, Artificial Sequence; identical to SEQ ID NO: 47439
  neuraminidase__InfluenzaA__ADM31601

SEQ ID NO: 50036 - RNA, 1410 nt, Artificial Sequence; identical to SEQ ID NO: 48530
  neuraminidase__InfluenzaA__ADM31611

SEQ ID NO: 50037 - RNA, 1410 nt, Artificial Sequence
  neuraminidase__InfluenzaA__ADM31621
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcuccuccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaauagaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50038 - RNA, 1410 nt, Artificial Sequence; identical to SEQ ID NO: 49929
  neuraminidase__InfluenzaA__ADM31631

SEQ ID NO: 50039 - RNA, 1410 nt, Artificial Sequence; identical to SEQ ID NO: 49212
  neuraminidase__InfluenzaA__ADM31641

SEQ ID NO: 50040 - RNA, 1410 nt, Artificial Sequence
  neuraminidase__InfluenzaA__ADM31651
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucagggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 50041 - RNA, 1410 nt, Artificial Sequence
  neuraminidase__InfluenzaA__ADM31661
augaauccaaaccaaaagauaauaaccauugguucggucuguaugacaauuggaauggcuaacuuaauauuacaaauugggaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaaauucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50042 - RNA, 1410 nt, Artificial Sequence
  neuraminidase__InfluenzaA__ADM31671
augaauccaaaccaaaagauaauaaccauugguucggucuguaugacaauuggaauggcuaacuuaauauuacaaauuggaaacauaaucucaauauggauuagccacucaacucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgcgaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaauuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 50043 - RNA, 1410 nt, Artificial Sequence; identical to SEQ ID NO: 49929
  neuraminidase__InfluenzaA__ADM31681

SEQ ID NO: 50044 - RNA, 1410 nt, Artificial Sequence
  neuraminidase__InfluenzaA__ADM31691
augaauccaaaccaaaagauacuaaccauugguucggucuguaugacaauuggaauggcuaacuuaauauuacaaauuggaaacauaaucucaauauggauuagccacucaauucaacuugggaaucaaaaucagacugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50045 - RNA, 1410 nt, Artificial Sequence; identical to SEQ ID NO: 47439
  neuraminidase__InfluenzaA__ADM31701

SEQ ID NO: 50046 - RNA, 1410 nt, Artificial Sequence
  neuraminidase__InfluenzaA__ADM31711
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucggacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaauacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50047 - RNA, 1410 nt, Artificial Sequence
  neuraminidase__InfluenzaA__ADM31721
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucaguaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagauacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuacccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50048 - RNA, 1410 nt, Artificial Sequence
  neuraminidase__InfluenzaA__ADM31731
augaauccaaaccaaaagauaauaaucauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagaaucugaaugugcauguguaaaugguucuugcuuuacuguaaugaccgauggaccaagugauggacaggccucauacaagaucuucagaauagaaaagggaaggauagucaaaucagucgaaaugaaugccccuaauuaucacuaugaggaaugcuccuguuauccugauucuagugaaaucacaugcgugugcagggauaacuggcauggcucgaaucgaccgugggugucuuucaaccagaaucuggaauaucagauaggauacauaugcagugggauuuucggagacaauccacgcccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagacccugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50049 - RNA, 1410 nt, Artificial Sequence; identical to SEQ ID NO: 49617
  neuraminidase__InfluenzaA__ADM31741

SEQ ID NO: 50050 - RNA, 1410 nt, Artificial Sequence
  neuraminidase__InfluenzaA__ADM31751
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucaucacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50051 - RNA, 1410 nt, Artificial Sequence
  neuraminidase__InfluenzaA__ADM31761
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccauaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaaauucucaauaaagcaagauaucguaggaauaagugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50052 - RNA, 1410 nt, Artificial Sequence
  neuraminidase__InfluenzaA__ADM31771
augaauccaaaccaaaagauacuaaccauugguucggucuguaugacaauuggaauggcuaacuuaauauuacaaauuggaaacauaaucucaauauggauuagccacucaauucaacuugggaaucaaaaucagacugaaacaugcaaucaaagcgucauuauuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50053 - RNA, 1410 nt, Artificial Sequence
  neuraminidase__InfluenzaA__ADM31801
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucaacaacaccaacuuugcugcuggacagucagugguuuccgugaaauuagcgggcaauuccucucucugcccuguuaguggaugggcuauauacaguaaagacaacaguauaagaaucggcuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaaauucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50054 - RNA, 1410 nt, Artificial Sequence
  neuraminidase__InfluenzaA__ADM31811
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuugcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguuccuucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagagauaacuggcauggcucgaaucgaccgugggugucuuucaaccagaaucuggaauaucagauaggauacauaugcagugggauuuucggagacaauccacgcccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaaguucucaauaaagcaggauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50055 - RNA, 1410 nt, Artificial Sequence; identical to SEQ ID NO: 49610
  neuraminidase__InfluenzaA__ADM31821

SEQ ID NO: 50056 - RNA, 1410 nt, Artificial Sequence; identical to SEQ ID NO: 49857
  neuraminidase__InfluenzaA__ADM31831

SEQ ID NO: 50057 - RNA, 1410 nt, Artificial Sequence; identical to SEQ ID NO: 49857
  neuraminidase__InfluenzaA__ADM31841

SEQ ID NO: 50058 - RNA, 1410 nt, Artificial Sequence
  neuraminidase__InfluenzaA__ADM31851
augaauccaaaccaaaagauacuaaccauugguucggucuguaugacaauuggaauggcuaacuuaauauuacaaauuggaaacauaaucucaauauggauuagccacucaauucaacuugggaaucaaaaucagacugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaggggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50059 - RNA, 1410 nt, Artificial Sequence; identical to SEQ ID NO: 49230
  neuraminidase__InfluenzaA__ADM31861

SEQ ID NO: 50060 - RNA, 1410 nt, Artificial Sequence; identical to SEQ ID NO: 47242
  neuraminidase__InfluenzaA__ADM31871

SEQ ID NO: 50061 - RNA, 1410 nt, Artificial Sequence
  neuraminidase__InfluenzaA__ADM31881
augaauccaaaccaaaagauaauaaccauugguucggucuguaugacaauuggaauggcuaacuuaauauuacaaauuggaaacacaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuucacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 50062 - RNA, 1410 nt, Artificial Sequence; identical to SEQ ID NO: 47439
  neuraminidase__InfluenzaA__ADM31891

SEQ ID NO: 50063 - RNA, 1410 nt, Artificial Sequence; identical to SEQ ID NO: 47241
  neuraminidase__InfluenzaA__ADM31901

SEQ ID NO: 50064 - RNA, 1410 nt, Artificial Sequence
  neuraminidase__InfluenzaA__ADM31911
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagugggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucaguugaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50065 - RNA, 1410 nt, Artificial Sequence; identical to SEQ ID NO: 48465
  neuraminidase__InfluenzaA__ADM31921

SEQ ID NO: 50066 - RNA, 1410 nt, Artificial Sequence
  neuraminidase__InfluenzaA__ADM31931
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcguaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacggccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50067 - RNA, 1410 nt, Artificial Sequence
  neuraminidase__InfluenzaA__ADM31941
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacucuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50068 - RNA, 1410 nt, Artificial Sequence; identical to SEQ ID NO: 48923
  neuraminidase__InfluenzaA__ADM31951

SEQ ID NO: 50069 - RNA, 1410 nt, Artificial Sequence
  neuraminidase__InfluenzaA__ADM31961
augaauccaaaccaaaagauaauaaccauugguucggucuguauggcaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucggccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50070 - RNA, 1410 nt, Artificial Sequence
  neuraminidase__InfluenzaA__ADM31971
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccaugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcguaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuacgaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50071 - RNA, 1410 nt, Artificial Sequence; identical to SEQ ID NO: 48465
  neuraminidase__InfluenzaA__ADM31981

SEQ ID NO: 50072 - RNA, 1410 nt, Artificial Sequence; identical to SEQ ID NO: 47241
  neuraminidase__InfluenzaA__ADM31991

SEQ ID NO: 50073 - RNA, 1410 nt, Artificial Sequence; identical to SEQ ID NO: 47241
  neuraminidase__InfluenzaA__ADM32001

SEQ ID NO: 50074 - RNA, 1410 nt, Artificial Sequence; identical to SEQ ID NO: 47872
  neuraminidase__InfluenzaA__ADM32011

SEQ ID NO: 50075 - RNA, 1410 nt, Artificial Sequence; identical to SEQ ID NO: 48745
  neuraminidase__InfluenzaA__ADM32021

SEQ ID NO: 50076 - RNA, 1410 nt, Artificial Sequence
  neuraminidase__InfluenzaA__ADM32031
augaauccaaaccaaaagauaauaaccauugguucggucuguaugacaauuggaauggcuaacuuaauauuacaaauuggaaacauaaucucaauauggauuagccacucaauucaacuuggggaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucaucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50077 - RNA, 1410 nt, Artificial Sequence
  neuraminidase__InfluenzaA__ADM32051
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuguuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaauagaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50078 - RNA, 1410 nt, Artificial Sequence; identical to SEQ ID NO: 47242
  neuraminidase__InfluenzaA__ADM32061

SEQ ID NO: 50079 - RNA, 1410 nt, Artificial Sequence; identical to SEQ ID NO: 47242
  neuraminidase__InfluenzaA__ADM32071

SEQ ID NO: 50080 - RNA, 1410 nt, Artificial Sequence
  neuraminidase__InfluenzaA__ADM32081
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucggccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50081 - RNA, 1410 nt, Artificial Sequence
  neuraminidase__InfluenzaA__ADM32091
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagugggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugcccuuuaccauugacaaguaa

SEQ ID NO: 50082 - RNA, 1410 nt, Artificial Sequence; identical to SEQ ID NO: 48745
  neuraminidase__InfluenzaA__ADM32101

SEQ ID NO: 50083 - RNA, 1410 nt, Artificial Sequence; identical to SEQ ID NO: 50080
  neuraminidase__InfluenzaA__ADM32111

SEQ ID NO: 50084 - RNA, 1410 nt, Artificial Sequence
  neuraminidase__InfluenzaA__ADM32554
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacacaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcguaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50085 - RNA, 1410 nt, Artificial Sequence; identical to SEQ ID NO: 47241
  neuraminidase__InfluenzaA__ADM32564

SEQ ID NO: 50086 - RNA, 1410 nt, Artificial Sequence
  neuraminidase__InfluenzaA__ADM32574
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagugggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaauuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50087 - RNA, 1410 nt, Artificial Sequence
  neuraminidase__InfluenzaA__ADM32584
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaggacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50088 - RNA, 1410 nt, Artificial Sequence; identical to SEQ ID NO: 48923
  neuraminidase__InfluenzaA__ADM32594

SEQ ID NO: 50089 - RNA, 1410 nt, Artificial Sequence; identical to SEQ ID NO: 50080
  neuraminidase__InfluenzaA__ADM32604

SEQ ID NO: 50090 - RNA, 1410 nt, Artificial Sequence
  neuraminidase__InfluenzaA__ADM32614
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucggccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggguggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50091 - RNA, 1410 nt, Artificial Sequence
  neuraminidase__InfluenzaA__ADM32624
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugacggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguuaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50092 - RNA, 1410 nt, Artificial Sequence
  neuraminidase__InfluenzaA__ADM32634
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcguaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggagcuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50093 - RNA, 1410 nt, Artificial Sequence
  neuraminidase__InfluenzaA__ADM32644
augaauccaaaccaaaagauaauaaccauugguucagucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50094 - RNA, 1410 nt, Artificial Sequence
  neuraminidase__InfluenzaA__ADM32664
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucaaauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccguuuaccauugacaaguaa

SEQ ID NO: 50095 - RNA, 1410 nt, Artificial Sequence; identical to SEQ ID NO: 48465
  neuraminidase__InfluenzaA__ADM32674

SEQ ID NO: 50096 - RNA, 1410 nt, Artificial Sequence; identical to SEQ ID NO: 50080
  neuraminidase__InfluenzaA__ADM32684

SEQ ID NO: 50097 - RNA, 1410 nt, Artificial Sequence
  neuraminidase__InfluenzaA__ADM32694
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauugcauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50098 - RNA, 1410 nt, Artificial Sequence; identical to SEQ ID NO: 47242
  neuraminidase__InfluenzaA__ADM32704

SEQ ID NO: 50099 - RNA, 1410 nt, Artificial Sequence; identical to SEQ ID NO: 48966
  neuraminidase__InfluenzaA__ADM32714

SEQ ID NO: 50100 - RNA, 1410 nt, Artificial Sequence; identical to SEQ ID NO: 48966
  neuraminidase__InfluenzaA__ADM32724

SEQ ID NO: 50101 - RNA, 1410 nt, Artificial Sequence; identical to SEQ ID NO: 50094
  neuraminidase__InfluenzaA__ADM32734

SEQ ID NO: 50102 - RNA, 1410 nt, Artificial Sequence; identical to SEQ ID NO: 48465
  neuraminidase__InfluenzaA__ADM32744

SEQ ID NO: 50103 - RNA, 1410 nt, Artificial Sequence; identical to SEQ ID NO: 48966
  neuraminidase__InfluenzaA__ADM32754

SEQ ID NO: 50104 - RNA, 1410 nt, Artificial Sequence; identical to SEQ ID NO: 48465
  neuraminidase__InfluenzaA__ADM32764

SEQ ID NO: 50105 - RNA, 1410 nt, Artificial Sequence
  neuraminidase__InfluenzaA__ADM32774
augaauccaaaccaaaagauaauaaucauugguucggucuguaugacaauuggaauggcuaacuuaauauuacaaauuggaaacauaaucucaauauggauuagccacucaauucaacuugggaaucaaaaucagauugaaacaugcaaucaaagcgucacuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50106 - RNA, 1410 nt, Artificial Sequence; identical to SEQ ID NO: 50076
  neuraminidase__InfluenzaA__ADM32784

SEQ ID NO: 50107 - RNA, 1410 nt, Artificial Sequence; identical to SEQ ID NO: 48911
  neuraminidase__InfluenzaA__ADM32794

SEQ ID NO: 50108 - RNA, 1410 nt, Artificial Sequence
  neuraminidase__InfluenzaA__ADM32804
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagugggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagagauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguagaaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50109 - RNA, 1410 nt, Artificial Sequence
  neuraminidase__InfluenzaA__ADM32814
augaauccaaaccaaaagauaauaaccauugguucggucuguaugacaauuggaauggcuaacuuaauauuacaaauuggaaacauaaucucaauauggauuagccacucaauucaacuugggaaucaaaaucagguugaaacaugcaaucaaagcgucauuacuuaugaaaacaacacuuggguaaaucagacauauguuaacaucagcaacaccaacuuugcagcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucggccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50110 - RNA, 1410 nt, Artificial Sequence; identical to SEQ ID NO: 47242
  neuraminidase__InfluenzaA__ADM32824

SEQ ID NO: 50111 - RNA, 1410 nt, Artificial Sequence; identical to SEQ ID NO: 48465
  neuraminidase__InfluenzaA__ADM32834

SEQ ID NO: 50112 - RNA, 1410 nt, Artificial Sequence; identical to SEQ ID NO: 47241
  neuraminidase__InfluenzaA__ADM32844

SEQ ID NO: 50113 - RNA, 1410 nt, Artificial Sequence
  neuraminidase__InfluenzaA__ADM32854
augaauccaaaccaaaagauaauaaccauugguucggucuguacgacaauuggaauggcuaacuuaauauuacaaauuggaaacauaaucucaauauggauuagccacucaauucaauuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagugggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50114 - RNA, 1410 nt, Artificial Sequence; identical to SEQ ID NO: 47872
  neuraminidase__InfluenzaA__ADM32864

SEQ ID NO: 50115 - RNA, 1410 nt, Artificial Sequence
  neuraminidase__InfluenzaA__ADM32874
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacacuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuacccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50116 - RNA, 1410 nt, Artificial Sequence
  neuraminidase__InfluenzaA__ADM32884
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcuguuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaaauucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50117 - RNA, 1410 nt, Artificial Sequence; identical to SEQ ID NO: 47242
  neuraminidase__InfluenzaA__ADM32921

SEQ ID NO: 50118 - RNA, 1410 nt, Artificial Sequence; identical to SEQ ID NO: 47242
  neuraminidase__InfluenzaA__ADM32931

SEQ ID NO: 50119 - RNA, 1410 nt, Artificial Sequence
  neuraminidase__InfluenzaA__ADM32941
augaauccaaaccaaaagauaauaaucauugguucggucuguaugacaauuggaauggcuaacuuaauauuacaaauuggaaacauuaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggagauguguuugucauaagggaaccauucauaucaugcucccccuuggaaugcagaaccuucuucuugacucaaggggccuugcuaaaugacaaacauucuaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaauucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50120 - RNA, 1410 nt, Artificial Sequence; identical to SEQ ID NO: 49993
  neuraminidase__InfluenzaA__ADM32951

SEQ ID NO: 50121 - RNA, 1410 nt, Artificial Sequence
  neuraminidase__InfluenzaA__ADM32960
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauucuucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccaucaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuucacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguuucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50122 - RNA, 1410 nt, Artificial Sequence
  neuraminidase__InfluenzaA__ADM32969
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuucacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguuucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50123 - RNA, 1410 nt, Artificial Sequence; identical to SEQ ID NO: 50122
  neuraminidase__InfluenzaA__ADM32979

SEQ ID NO: 50124 - RNA, 1410 nt, Artificial Sequence; identical to SEQ ID NO: 49997
  neuraminidase__InfluenzaA__ADM32988

SEQ ID NO: 50125 - RNA, 1410 nt, Artificial Sequence
  neuraminidase__InfluenzaA__ADM32997
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaaaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50126 - RNA, 1410 nt, Artificial Sequence
  neuraminidase__InfluenzaA__ADM33006
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauauuguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50127 - RNA, 1410 nt, Artificial Sequence; identical to SEQ ID NO: 50125
  neuraminidase__InfluenzaA__ADM33015

SEQ ID NO: 50128 - RNA, 1410 nt, Artificial Sequence
  neuraminidase__InfluenzaA__ADM33025
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuuacuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaagcaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucaaaucgaccgugggugucuuucaaccagaaucuggaauaucagauaggauacauaugcagugggauuuucggagacaauccacguccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50129 - RNA, 1410 nt, Artificial Sequence; identical to SEQ ID NO: 47242
  neuraminidase__InfluenzaA__ADM33042

SEQ ID NO: 50130 - RNA, 1410 nt, Artificial Sequence; identical to SEQ ID NO: 50013
  neuraminidase__InfluenzaA__ADM33062

SEQ ID NO: 50131 - RNA, 1410 nt, Artificial Sequence
  neuraminidase__InfluenzaA__ADM33071
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccuccccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuaguaaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacggugacacuguggguuggucuuggccagacggugcugaguugccauuuaccauugacaaguaa

SEQ ID NO: 50132 - RNA, 1410 nt, Artificial Sequence; identical to SEQ ID NO: 50013
  neuraminidase__InfluenzaA__ADM33081

SEQ ID NO: 50133 - RNA, 1410 nt, Artificial Sequence
  neuraminidase__InfluenzaA__ADM33091
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggauaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguccccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcguguguaaaugguucuugcuuuacuguaaugaccgauggaccaagugauggacaggccucauacaaaaucuucagaauagaaaagggaaagauaguuaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50134 - RNA, 1410 nt, Artificial Sequence; identical to SEQ ID NO: 50133
  neuraminidase__InfluenzaA__ADM33101

SEQ ID NO: 50135 - RNA, 1410 nt, Artificial Sequence; identical to SEQ ID NO: 50133
  neuraminidase__InfluenzaA__ADM33111

SEQ ID NO: 50136 - RNA, 1410 nt, Artificial Sequence
  neuraminidase__InfluenzaA__ADM33121
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucucccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50137 - RNA, 1410 nt, Artificial Sequence; identical to SEQ ID NO: 50136
  neuraminidase__InfluenzaA__ADM33130

SEQ ID NO: 50138 - RNA, 1410 nt, Artificial Sequence; identical to SEQ ID NO: 50136
  neuraminidase__InfluenzaA__ADM33139

SEQ ID NO: 50139 - RNA, 1410 nt, Artificial Sequence; identical to SEQ ID NO: 50136
  neuraminidase__InfluenzaA__ADM33149

SEQ ID NO: 50140 - RNA, 1410 nt, Artificial Sequence; identical to SEQ ID NO: 50136
  neuraminidase__InfluenzaA__ADM33159

SEQ ID NO: 50141 - RNA, 1410 nt, Artificial Sequence; identical to SEQ ID NO: 47707
  neuraminidase__InfluenzaA__ADM33169

SEQ ID NO: 50142 - RNA, 1410 nt, Artificial Sequence; identical to SEQ ID NO: 47707
  neuraminidase__InfluenzaA__ADM33179

SEQ ID NO: 50143 - RNA, 1410 nt, Artificial Sequence; identical to SEQ ID NO: 50136
  neuraminidase__InfluenzaA__ADM33188

SEQ ID NO: 50144 - RNA, 1410 nt, Artificial Sequence; identical to SEQ ID NO: 50136
  neuraminidase__InfluenzaA__ADM33197

SEQ ID NO: 50145 - RNA, 1410 nt, Artificial Sequence; identical to SEQ ID NO: 47242
  neuraminidase__InfluenzaA__ADM33206

SEQ ID NO: 50146 - RNA, 1410 nt, Artificial Sequence; identical to SEQ ID NO: 47242
  neuraminidase__InfluenzaA__ADM33215

SEQ ID NO: 50147 - RNA, 1410 nt, Artificial Sequence; identical to SEQ ID NO: 47242
  neuraminidase__InfluenzaA__ADM33224

SEQ ID NO: 50148 - RNA, 1410 nt, Artificial Sequence; identical to SEQ ID NO: 47242
  neuraminidase__InfluenzaA__ADM33234

SEQ ID NO: 50149 - RNA, 1410 nt, Artificial Sequence; identical to SEQ ID NO: 47688
  neuraminidase__InfluenzaA__ADM33243

SEQ ID NO: 50150 - RNA, 1410 nt, Artificial Sequence; identical to SEQ ID NO: 47242
  neuraminidase__InfluenzaA__ADM33253

SEQ ID NO: 50151 - RNA, 1410 nt, Artificial Sequence; identical to SEQ ID NO: 47688
  neuraminidase__InfluenzaA__ADM33262

SEQ ID NO: 50152 - RNA, 1410 nt, Artificial Sequence
  neuraminidase__InfluenzaA__ADM33272
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguugguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagggggcgacccaaagagaacacaauuuggacuagcgggagcagcauauccuuuugugguguaaacagugacacuguggguuggucuuggccagacggugcugaguugccauuuaccauugacaaguaa

SEQ ID NO: 50153 - RNA, 1410 nt, Artificial Sequence; identical to SEQ ID NO: 47272
  neuraminidase__InfluenzaA__ADM33282

SEQ ID NO: 50154 - RNA, 1410 nt, Artificial Sequence; identical to SEQ ID NO: 47306
  neuraminidase__InfluenzaA__ADM33292

SEQ ID NO: 50155 - RNA, 1410 nt, Artificial Sequence; identical to SEQ ID NO: 47242
  neuraminidase__InfluenzaA__ADM33302

SEQ ID NO: 50156 - RNA, 1410 nt, Artificial Sequence
  neuraminidase__InfluenzaA__ADM33312
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagaaucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50157 - RNA, 1410 nt, Artificial Sequence; identical to SEQ ID NO: 47272
  neuraminidase__InfluenzaA__ADM33322

SEQ ID NO: 50158 - RNA, 1410 nt, Artificial Sequence; identical to SEQ ID NO: 47272
  neuraminidase__InfluenzaA__ADM33332

SEQ ID NO: 50159 - RNA, 1410 nt, Artificial Sequence
  neuraminidase__InfluenzaA__ADM33342
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacaaucagugguuuccgugaaauuagcaggcaauuccucucucugcccuguugguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50160 - RNA, 1410 nt, Artificial Sequence
  neuraminidase__InfluenzaA__ADM33367
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucguuacuuaugaaaacaacacuuggguaaaucagacauauguuaacaucagcaacaccaacuuugcugcuggacagucagugguuuccgugaaauuagcgggcaauuccucucucugcccuguugguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50161 - RNA, 1410 nt, Artificial Sequence; identical to SEQ ID NO: 47272
  neuraminidase__InfluenzaA__ADM33377

SEQ ID NO: 50162 - RNA, 1410 nt, Artificial Sequence; identical to SEQ ID NO: 47272
  neuraminidase__InfluenzaA__ADM33387

SEQ ID NO: 50163 - RNA, 1410 nt, Artificial Sequence; identical to SEQ ID NO: 47306
  neuraminidase__InfluenzaA__ADM33397

SEQ ID NO: 50164 - RNA, 1410 nt, Artificial Sequence; identical to SEQ ID NO: 47306
  neuraminidase__InfluenzaA__ADM33407

SEQ ID NO: 50165 - RNA, 1410 nt, Artificial Sequence; identical to SEQ ID NO: 47272
  neuraminidase__InfluenzaA__ADM33417

SEQ ID NO: 50166 - RNA, 1410 nt, Artificial Sequence; identical to SEQ ID NO: 48264
  neuraminidase__InfluenzaA__ADM33427

SEQ ID NO: 50167 - RNA, 1410 nt, Artificial Sequence
  neuraminidase__InfluenzaA__ADM33437
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucugcauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50168 - RNA, 1410 nt, Artificial Sequence; identical to SEQ ID NO: 47649
  neuraminidase__InfluenzaA__ADM33443

SEQ ID NO: 50169 - RNA, 1410 nt, Artificial Sequence; identical to SEQ ID NO: 49200
  neuraminidase__InfluenzaA__ADM52446

SEQ ID NO: 50170 - RNA, 1410 nt, Artificial Sequence; identical to SEQ ID NO: 49552
  neuraminidase__InfluenzaA__ADM52456

SEQ ID NO: 50171 - RNA, 1410 nt, Artificial Sequence; identical to SEQ ID NO: 50026
  neuraminidase__InfluenzaA__ADM52466

SEQ ID NO: 50172 - RNA, 1410 nt, Artificial Sequence; identical to SEQ ID NO: 47242
  neuraminidase__InfluenzaA__ADM52486

SEQ ID NO: 50173 - RNA, 1410 nt, Artificial Sequence; identical to SEQ ID NO: 47241
  neuraminidase__InfluenzaA__ADM52496

SEQ ID NO: 50174 - RNA, 1410 nt, Artificial Sequence; identical to SEQ ID NO: 47242
  neuraminidase__InfluenzaA__ADM52506

SEQ ID NO: 50175 - RNA, 1410 nt, Artificial Sequence; identical to SEQ ID NO: 47872
  neuraminidase__InfluenzaA__ADM52516

SEQ ID NO: 50176 - RNA, 1410 nt, Artificial Sequence; identical to SEQ ID NO: 47241
  neuraminidase__InfluenzaA__ADM52527

SEQ ID NO: 50177 - RNA, 1410 nt, Artificial Sequence
  neuraminidase__InfluenzaA__ADM52537
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagugggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugaggacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50178 - RNA, 1410 nt, Artificial Sequence; identical to SEQ ID NO: 48966
  neuraminidase__InfluenzaA__ADM52547

SEQ ID NO: 50179 - RNA, 1410 nt, Artificial Sequence; identical to SEQ ID NO: 47241
  neuraminidase__InfluenzaA__ADM52557

SEQ ID NO: 50180 - RNA, 1410 nt, Artificial Sequence; identical to SEQ ID NO: 47872
  neuraminidase__InfluenzaA__ADM52567

SEQ ID NO: 50181 - RNA, 1410 nt, Artificial Sequence
  neuraminidase__InfluenzaA__ADM52577
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccaaaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauacagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50182 - RNA, 1410 nt, Artificial Sequence; identical to SEQ ID NO: 47242
  neuraminidase__InfluenzaA__ADM52587

SEQ ID NO: 50183 - RNA, 1410 nt, Artificial Sequence; identical to SEQ ID NO: 47242
  neuraminidase__InfluenzaA__ADM52597

SEQ ID NO: 50184 - RNA, 1410 nt, Artificial Sequence; identical to SEQ ID NO: 47241
  neuraminidase__InfluenzaA__ADM52607

SEQ ID NO: 50185 - RNA, 1410 nt, Artificial Sequence; identical to SEQ ID NO: 47872
  neuraminidase__InfluenzaA__ADM52617

SEQ ID NO: 50186 - RNA, 1410 nt, Artificial Sequence
  neuraminidase__InfluenzaA__ADM52627
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcguaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50187 - RNA, 1410 nt, Artificial Sequence; identical to SEQ ID NO: 50177
  neuraminidase__InfluenzaA__ADM52637

SEQ ID NO: 50188 - RNA, 1410 nt, Artificial Sequence; identical to SEQ ID NO: 48465
  neuraminidase__InfluenzaA__ADM52647

SEQ ID NO: 50189 - RNA, 1410 nt, Artificial Sequence; identical to SEQ ID NO: 47872
  neuraminidase__InfluenzaA__ADM52657

SEQ ID NO: 50190 - RNA, 1410 nt, Artificial Sequence; identical to SEQ ID NO: 48465
  neuraminidase__InfluenzaA__ADM52667

SEQ ID NO: 50191 - RNA, 1410 nt, Artificial Sequence; identical to SEQ ID NO: 50067
  neuraminidase__InfluenzaA__ADM52687

SEQ ID NO: 50192 - RNA, 1410 nt, Artificial Sequence
  neuraminidase__InfluenzaA__ADM52697
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacaccaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50193 - RNA, 1410 nt, Artificial Sequence; identical to SEQ ID NO: 48923
  neuraminidase__InfluenzaA__ADM52707

SEQ ID NO: 50194 - RNA, 1410 nt, Artificial Sequence
  neuraminidase__InfluenzaA__ADM52717
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagcgguuuccgugaaauuagugggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50195 - RNA, 1410 nt, Artificial Sequence
  neuraminidase__InfluenzaA__ADM86402
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucaguggcuuccgugaaauuagcgggcaauucuucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccguuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauuccagugaaaucacaugugugugcagggauaacuggcauggcucgaaucgaccguggguuucuuucaaccagaaucuggaauaucagauaggauacauaugcagugggauuuucggagacaauccacgcccuaaugauaagacaggcaguugugguccaguaucguccaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50196 - RNA, 1410 nt, Artificial Sequence; identical to SEQ ID NO: 47439
  neuraminidase__InfluenzaA__ADM86412

SEQ ID NO: 50197 - RNA, 1410 nt, Artificial Sequence
  neuraminidase__InfluenzaA__ADM86422
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacauaagcaacaccaacuuuguugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaaccuuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagguagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50198 - RNA, 1410 nt, Artificial Sequence
  neuraminidase__InfluenzaA__ADM86432
augaauccaaaucaaaagauaauaacgauuggcucuguuucucucaccauuuccacaauaugcuucuucaugcaaaccgccauccugauaacuacuguaacauugcauuucaagcaaugugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaauggaaggcuuguagauaguguuguuucaugguccaaagaaauccucaggacccaggagucagaaugcguuuguaucaauggaacuuguacaguaguaaugacugaugggagugcuucagggaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaaaucacgcuuaggguaugaaaccuucaaagucauugaaggcugguccaacccuaaguccaaauugcagauaaauaggcaagucauaguugauagagguaauagguccgguuauucugguauuuucucuguugaaggcaaaagcugcaucaaccggugcuuuuauguggaguugauaaggggaaggaaagaggaaacugaagucuuguggaccucaaacaguauuguuguguuuuguggcaccucagguacauauggaacaggcucauggccugauggggcggacaucaaucucaugccuauauaa

SEQ ID NO: 50199 - RNA, 1410 nt, Artificial Sequence
  neuraminidase__InfluenzaA__ADM86443
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaauguguauguguaaaugguucuugcuucacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaaugaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 50200 - RNA, 1410 nt, Artificial Sequence; identical to SEQ ID NO: 50025
  neuraminidase__InfluenzaA__ADM86453

SEQ ID NO: 50201 - RNA, 1350 nt, Artificial Sequence
  neuraminidase__InfluenzaA__ADM95377
augaauccaaaucagaagauaauaaccaucggaucaaucuguaugguaacuggaauaguuagcuuaauguuacaaguugggagcaugaucucaauaugggucagucauucaauucacacagggaaucagcaccaagcugagccaaucagcaauacuaauuuucuuacugagaaagcuguggcuucaguaaaauuagcgggcaauucaucucuuugccccauuaacggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaaacacuccaaugggacugucaaagacagaagcccucacagaacauuaaugaguuguccuaugggugaggcucccuccccauacaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugauggaccaaguaauggucaggcaucacauaagaucuucaaaauggaaaaaggaaaagugauuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaacuuggaguaucaaauaggauauauaugcagugggguuuucggagacaauccacgccccaaugauggaacagguaguugugguccgguguccucuaacggggcauaugggguaaaaggguuuucauuuaaauacggcaauggugucuggaucgggagaaccaaaagcacuaauuccaggagcggcuuugaaaugauuugggauccaaauggguggacugaaacggacaguagauuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 50202 - RNA, 1410 nt, Artificial Sequence; identical to SEQ ID NO: 47242
  neuraminidase__InfluenzaA__ADM95650

SEQ ID NO: 50203 - RNA, 1410 nt, Artificial Sequence; identical to SEQ ID NO: 47379
  neuraminidase__InfluenzaA__ADM95651

SEQ ID NO: 50204 - RNA, 1410 nt, Artificial Sequence
  neuraminidase__InfluenzaA__ADM95652
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuugcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaauugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50205 - RNA, 1410 nt, Artificial Sequence
  neuraminidase__InfluenzaA__ADM95654
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagacacgguuuugagaugauuugggauccgaacggauggacugggacagacaauaacuucucaauaaagcaagauaucguaggaacaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50206 - RNA, 1410 nt, Artificial Sequence
  neuraminidase__InfluenzaA__ADM95655
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaacggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuagugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaaugacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50207 - RNA, 1410 nt, Artificial Sequence
  neuraminidase__InfluenzaA__ADM95656
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaauggauggacugggacagacaauaacuucucaauaaagcaagauaucguaggaacaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50208 - RNA, 1410 nt, Artificial Sequence
  neuraminidase__InfluenzaA__ADM95658
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucaguaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaaguucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50209 - RNA, 1410 nt, Artificial Sequence
  neuraminidase__InfluenzaA__ADM95659
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaagcgguuuugagaugauuugggauccgaacggauggacugggacagacaauaacuucucaauaaagcaagauaucauaggaacaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50210 - RNA, 1410 nt, Artificial Sequence
  neuraminidase__InfluenzaA__ADM95660
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaacgauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50211 - RNA, 1410 nt, Artificial Sequence
  neuraminidase__InfluenzaA__ADM95661
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaacaaaugaguggucaggauauagcgggaguuuuguucagcauccagaacuaacagggcuggauuguauaagaccuugcuucuggguugaacuaaucagagggcgacccaaagagaacacaaucuggacuagcgggagcaucauauccuuuugugguguaaacagugacacuguggguuggucuuggccagacggugcugaguugccauuuaccauugacaaguaa

SEQ ID NO: 50212 - RNA, 1410 nt, Artificial Sequence
  neuraminidase__InfluenzaA__ADM95662
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaacaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50213 - RNA, 1410 nt, Artificial Sequence
  neuraminidase__InfluenzaA__ADM95663
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaauggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgccuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucaaucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaacaaaugaguggucaggauauagcgggaguuuuguucagcauccagaacuaacagggcuggauuguauaagaccuugcuucuggguugaacuaaucagagggcgacccaaagagaacacaaucuggacuagcgggagcaucauauccuuuuguggugugaacagugacacuguggguuggucuuggccagacggugcugaguugccauuuaccauugacaaguaa

SEQ ID NO: 50214 - RNA, 1410 nt, Artificial Sequence; identical to SEQ ID NO: 50212
  neuraminidase__InfluenzaA__ADM95664

SEQ ID NO: 50215 - RNA, 1410 nt, Artificial Sequence
  neuraminidase__InfluenzaA__ADM95665
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacgggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaacaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50216 - RNA, 1410 nt, Artificial Sequence
  neuraminidase__InfluenzaA__ADM95666
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaauggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgccuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaaaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucguuuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaacaaaugaguggucaggauauagcgggaguuuuguucagcauccagaacuaacagggcuggauuguauaagaccuugcuucuggguugaacuaaucagagggcgacccaaagagaacacaaucuggacuagcgggagcaucauauccuuuuguggugugaacagugacacuguggguuggucuuggccagacggugcugaguugccauuuaccauugacaaguaa

SEQ ID NO: 50217 - RNA, 1410 nt, Artificial Sequence; identical to SEQ ID NO: 50212
  neuraminidase__InfluenzaA__ADM95667

SEQ ID NO: 50218 - RNA, 1410 nt, Artificial Sequence; identical to SEQ ID NO: 50212
  neuraminidase__InfluenzaA__ADM95668

SEQ ID NO: 50219 - RNA, 1410 nt, Artificial Sequence; identical to SEQ ID NO: 47242
  neuraminidase__InfluenzaA__ADM95669

SEQ ID NO: 50220 - RNA, 1410 nt, Artificial Sequence; identical to SEQ ID NO: 47242
  neuraminidase__InfluenzaA__ADM95670

SEQ ID NO: 50221 - RNA, 1410 nt, Artificial Sequence
  neuraminidase__InfluenzaA__ADM95672
augaauccaaaccaaaagauaauaaccauugguucggucuguaugacaauuggaauggcuaacuuaauauuacaaauuggaaacauaaucucaauauggauuagccacacaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacugugaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaacaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50222 - RNA, 1410 nt, Artificial Sequence; identical to SEQ ID NO: 47306
  neuraminidase__InfluenzaA__ADM95673

SEQ ID NO: 50223 - RNA, 1410 nt, Artificial Sequence; identical to SEQ ID NO: 50212
  neuraminidase__InfluenzaA__ADM95674

SEQ ID NO: 50224 - RNA, 1410 nt, Artificial Sequence; identical to SEQ ID NO: 47242
  neuraminidase__InfluenzaA__ADM95675

SEQ ID NO: 50225 - RNA, 1410 nt, Artificial Sequence
  neuraminidase__InfluenzaA__ADM95677
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaauggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgccuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaacaaaugaguggucaggauauagcgggaguuuuguucagcauccagaacuaacagggcuggauuguauaagaccuugcuucuggguugaacuaaucagagggcgacccaaagagaacacaaucuggacuagcgggagcaucauauccuuuuguggugugaacagugacacuguggguuggucuuggccagacggugcugaguugccauuuaccauugacaaguaa

SEQ ID NO: 50226 - RNA, 1410 nt, Artificial Sequence
  neuraminidase__InfluenzaA__ADM95678
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuugcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50227 - RNA, 1410 nt, Artificial Sequence; identical to SEQ ID NO: 50225
  neuraminidase__InfluenzaA__ADM95679

SEQ ID NO: 50228 - RNA, 1410 nt, Artificial Sequence; identical to SEQ ID NO: 50225
  neuraminidase__InfluenzaA__ADM95680

SEQ ID NO: 50229 - RNA, 1410 nt, Artificial Sequence
  neuraminidase__InfluenzaA__ADM95681
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcggcccaaagagaacacaaucuggacuagcgggagcagcauauccuuuugugguguaaacagugacacuguggguuggucuuggccagacggugcugaguugccauuuaccauugacaaguaa

SEQ ID NO: 50230 - RNA, 1410 nt, Artificial Sequence
  neuraminidase__InfluenzaA__ADM95682
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaauaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggaggaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaacaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50231 - RNA, 1410 nt, Artificial Sequence
  neuraminidase__InfluenzaA__ADM95683
augaauccaaaccaaaagauaauaaccauugguucggucuguaugacaauuggaauggcuaacuuaauauuacaaauuggaaauauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauguccuuuugugguguaaacagugacacuguggguuggucuuggccagacggugcugaguugccauuuaccauugacaaguaa

SEQ ID NO: 50232 - RNA, 1410 nt, Artificial Sequence; identical to SEQ ID NO: 47242
  neuraminidase__InfluenzaA__ADM95684

SEQ ID NO: 50233 - RNA, 1410 nt, Artificial Sequence
  neuraminidase__InfluenzaA__ADM95685
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagugucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagacacgguuuugagaugauuugggauccgaacggauggacugggacagacaauaacuucucaauaaagcaagauaucguaggaacaaaugaguggucaggauauagcgggaguuuuguucagcauccagaacuaacagggcuggauuguauaagaccuugcuucuggguugaacuaaucagagggcgacccaaagagaacacagucuggacuagcgggagcagcauauccuuuugugguguaaacagugacacuguggguuggucuuggccagacggugcugaguugccauuuaccauugacaaguaa

SEQ ID NO: 50234 - RNA, 1410 nt, Artificial Sequence
  neuraminidase__InfluenzaA__ADM95686
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaaugacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50235 - RNA, 1410 nt, Artificial Sequence
  neuraminidase__InfluenzaA__ADM95687
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaggagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50236 - RNA, 1410 nt, Artificial Sequence
  neuraminidase__InfluenzaA__ADM95688
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgccuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaacaaaugaguggucaggauauagcgggaguuuuguucagcauccagaacuaacaaggcuggauuguauaagaccuugcuucuggguugaacuaaucagagggcgacccaaagagaacacaaucuggacuagcgggagcaucauauccuuuuguggugugaacagugacacuguggguuggucuuggccagacggugcugaguugccauuuaccauugacaaguaa

SEQ ID NO: 50237 - RNA, 1410 nt, Artificial Sequence; identical to SEQ ID NO: 50234
  neuraminidase__InfluenzaA__ADM95689

SEQ ID NO: 50238 - RNA, 1410 nt, Artificial Sequence
  neuraminidase__InfluenzaA__ADM95690
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaauaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucauaggaacaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50239 - RNA, 1410 nt, Artificial Sequence
  neuraminidase__InfluenzaA__ADM95691
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaaccaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50240 - RNA, 1410 nt, Artificial Sequence
  neuraminidase__InfluenzaA__ADM95692
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucaucaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuagaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50241 - RNA, 1410 nt, Artificial Sequence
  neuraminidase__InfluenzaA__ADM95693
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuagaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50242 - RNA, 1410 nt, Artificial Sequence
  neuraminidase__InfluenzaA__ADM95694
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaguuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50243 - RNA, 1410 nt, Artificial Sequence; identical to SEQ ID NO: 47242
  neuraminidase__InfluenzaA__ADM95695

SEQ ID NO: 50244 - RNA, 1410 nt, Artificial Sequence; identical to SEQ ID NO: 50234
  neuraminidase__InfluenzaA__ADM95696

SEQ ID NO: 50245 - RNA, 1410 nt, Artificial Sequence; identical to SEQ ID NO: 50212
  neuraminidase__InfluenzaA__ADM95697

SEQ ID NO: 50246 - RNA, 1413 nt, Artificial Sequence
  neuraminidase__InfluenzaA__ADM95698
augaacccaaaucaaaagauaauaaccauuggaucaaucaguauagcaaucggaauaauuagucugauguugcaaauaggaaauauuauuucaauaugggcuagucacucaauccaaacuggaagucaaaacaacacuggaauaugcaaccaaagaaucaucacauaugaaaacaacaccugggugaaucacacauauguuaauauuaacaacacuaauguuguugcugaagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaccaaaacuuggauuaucaaauaggauacaucugcaguggaguguucggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuggucagagggcagccuagagaaaauacaacaaucuggacuagugggagcagcauuucuuuuuguggcguuaauagugauacugcaaacuggucuuggccagacggugcugaguugccguucaccauugacaaguag

SEQ ID NO: 50247 - RNA, 1413 nt, Artificial Sequence
  neuraminidase__InfluenzaA__ADM95699
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacaacaccugggugaaucacacauauguuaauauuaacaacacuaauguuguugcugaagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggagugcagaaccuuuuuucugacccaaggcgcucuauuaaaugacaaacauucaaaugggaccguaaaggacagaaguccuuauagggccuuaaugagcuguccucuuggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucacaauaaugaccgauggcccgaguaauaaggccgccucguacaaaauuuucaagaucgaaaaggggaagguuacuaaaucaauagaguugaaugcacccaauuuuuauuaugaggaauguuccuguuacccagacacuggcauagugauguguguauguagggacaacuggcaugguucaaaucgaccuugggugucuuuuaaucaaaacuuggauuaucaaauaggauacaucugcaguggaguguucggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuggucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50248 - RNA, 1413 nt, Artificial Sequence
  neuraminidase__InfluenzaA__ADM95701
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacaacaccugggugaaucacacauauguuaauauuaacaacacuaauguuguugcugaagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaccaaaacuuggauuaucaaauaggauacaucugcaguggaguguucggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuggucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50249 - RNA, 1413 nt, Artificial Sequence
  neuraminidase__InfluenzaA__ADM95702
augaacccaaaucaaaagauaauaaccauuggaucaaucaguauagcaaucggaauaauuagucuaauguugcaaauaggaaauauuauuucaauaugggccagucacucaauccaaacuggacgucaaaacaacacuggaauaugcaaccaaagaaucaucacauaugaaaacagcaccugggugaaucacacauauguuaauauuaacaacacuaaaguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugggguuuggauaggaaggaccaaaaguaacagacuuagaaagggguuugaggugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 50250 - RNA, 1413 nt, Artificial Sequence
  neuraminidase__InfluenzaA__ADM95704
augaacccaaaucaaaagauaauaaccauuggaucaaucaguauagcaaucggaauaauuagucuaauguugcaaauaggaaauauuguuucaauaugggcuagucacucaauccaaacuggaagucaaaacaacacuggaauaugcaaccaaagaaucaucacauaugaaaacaacaccugggugaaucacacauauguuaauauuaacaacacuaauguuguugcugaagaggacaaaacuucagugacauuggcuggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucacaauaaugaccgauggcccgaguaauagggccgccucguacaaaauuuucaagaucgaaaaggggaaaguuacuaaaucaauagaguugaaugcacccaauuuucauuaugaggaauguuccuguuacccagacacuggcauagugauguguguaugcagggacaacuggcaugguucaaaucgaccuuggguuucuuuuaaccaaaacuuggauuaucaaauaggauacaucugcaguggaguguucggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuggucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50251 - RNA, 1413 nt, Artificial Sequence
  neuraminidase__InfluenzaA__ADM95705
augaacccaaaucaaaagauaauaaccauuggaucaaucaguauagcaaucggaauaauuagucuaauguugcaaauaggaaauauuauuucaauaugggccagucacucaauccaaacuggacgucaaaacaacacuggaauaugcaaccaaagaaucaucacauaugaaaacagcaccugggugaaucacacauauguuaauauuaacaacacuaaaguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugggguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 50252 - RNA, 1413 nt, Artificial Sequence; identical to SEQ ID NO: 50251
  neuraminidase__InfluenzaA__ADM95706

SEQ ID NO: 50253 - RNA, 1413 nt, Artificial Sequence; identical to SEQ ID NO: 50251
  neuraminidase__InfluenzaA__ADM95707

SEQ ID NO: 50254 - RNA, 1413 nt, Artificial Sequence
  neuraminidase__InfluenzaA__ADM95708
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50255 - RNA, 1410 nt, Artificial Sequence
  neuraminidase__InfluenzaA__ADM95710
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauaacauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaugucuuguggaccucaaacaguauuguuguguuuuguggcaccucagguacauauggaacaggcucauggccugauggggcggacaucaaucucaugccuauauaa

SEQ ID NO: 50256 - RNA, 1410 nt, Artificial Sequence
  neuraminidase__InfluenzaA__ADM95711
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguauaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50257 - RNA, 1410 nt, Artificial Sequence; identical to SEQ ID NO: 50256
  neuraminidase__InfluenzaA__ADM95712

SEQ ID NO: 50258 - RNA, 1410 nt, Artificial Sequence; identical to SEQ ID NO: 47103
  neuraminidase__InfluenzaA__ADM95713

SEQ ID NO: 50259 - RNA, 1410 nt, Artificial Sequence
  neuraminidase__InfluenzaA__ADM95714
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaauccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaugucuuguggaccucaaacaguauuguuguguuuuguggcaccucagguacauauggaacaggcucauggccugauggggcggacaucaaucucaugccuauauaa

SEQ ID NO: 50260 - RNA, 1410 nt, Artificial Sequence; identical to SEQ ID NO: 47103
  neuraminidase__InfluenzaA__ADM95715

SEQ ID NO: 50261 - RNA, 1410 nt, Artificial Sequence
  neuraminidase__InfluenzaA__ADM95716
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaugucuuguggaccucaaacaguauuguuguguuuuguggcaccucagguacauauggaacaggcucauggccugauggggcggacaucaaucucaugccuauauaa

SEQ ID NO: 50262 - RNA, 1410 nt, Artificial Sequence
  neuraminidase__InfluenzaA__ADM95717
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucagggaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaugucuuguggaccucaaacaguauuguuguguuuuguggcaccucaggcacauauggaacaggcucauggccugauggggcggacaucaaucucaugccuauauaa

SEQ ID NO: 50263 - RNA, 1410 nt, Artificial Sequence; identical to SEQ ID NO: 47103
  neuraminidase__InfluenzaA__ADM95718

SEQ ID NO: 50264 - RNA, 1410 nt, Artificial Sequence
  neuraminidase__InfluenzaA__ADM95719
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacucgcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcucaggguaugaaaccuucaaagucauugaaggcugguccaacccuaaguccaaauugcagauaaauaggcaagucauaguugacagagguaauagguccgguuauucugguauuuucucuguugaaggaaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50265 - RNA, 1410 nt, Artificial Sequence; identical to SEQ ID NO: 47103
  neuraminidase__InfluenzaA__ADM95720

SEQ ID NO: 50266 - RNA, 1410 nt, Artificial Sequence; identical to SEQ ID NO: 47103
  neuraminidase__InfluenzaA__ADM95721

SEQ ID NO: 50267 - RNA, 1410 nt, Artificial Sequence
  neuraminidase__InfluenzaA__ADM95723
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucaauuaggcuuuccgcugguggggacaucugggugacaagagaaccuuaugugucaugcgauccugacaaguguuaucaauuugcccuuggacagggaacaacacuaaacaacgugcauucaaauaacacaguacgugacaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccuuaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaacgacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50268 - RNA, 1410 nt, Artificial Sequence
  neuraminidase__InfluenzaA__ADM95724
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaagcugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50269 - RNA, 1410 nt, Artificial Sequence
  neuraminidase__InfluenzaA__ADM95725
augaauccaaaucaaaagauaauaacgauuggcucuguuucucucaccauuuccacaauaugcuucuucaugcaaauugccaucuugauaacuacuguaacauugcauuucaagcaauaugaauucaacccccccccaaacaaccaagugaugcugugugaaccaacaauaauagaaagaaacauaacagagauaguguaucugaccaacaccaccauagagaaggaaguaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaauaacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaauccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaugucuuguggaccucaaacaguauuguuguguuuuguggcaccucagguacauauggaacaggcucauggccugauggggcggacaucaaucucaugccuauauaa

SEQ ID NO: 50270 - RNA, 1410 nt, Artificial Sequence
  neuraminidase__InfluenzaA__ADM95726
augaauccaaaucaaaagauaauaacgauuggcucuguuucucucaccauuuccacaauaugcuucuucaugcaaauugccaucuugauaacugcuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaugucuuguggaccucaaacaguauuguuguguuuuguggcaccucagguacauauggaacaggcucauggccugauggggcggacaucaaucucaugccuauauaa

SEQ ID NO: 50271 - RNA, 1410 nt, Artificial Sequence
  neuraminidase__InfluenzaA__ADM95727
augaauccaaaucaaaagauaauaacgauuggcucuguuucucucaccauuuccacaauaugcuucuucaugcaaauugccaucuugauaacuacuguaacauugcauuucaagcaauaugaauucaacucacccccaaacaaccaagugaugcugugugaaccaacaauaauagaaagaaacauaacagagauaguguaucugaccaacaccaccauagagaaggaaauaugccccaaacuagcagaauacagaaauuggucaaagccccaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50272 - RNA, 1410 nt, Artificial Sequence
  neuraminidase__InfluenzaA__ADM95728
augaauccaaaucaaaagauaauaacgauuggcucuguuucucucaccauuuccacaauaugcuucuucaugcaaauugccaucuugauaacuacugugacauugcauuucaagcaauaugaauucaacucccccccaaacaaccaagugaugcugugugaaccaacaauaauagaaagaaacauaacagagauaguguaucugaccaacaccaccauagagaaggaaauaugccccgaacuagcagaauacagaaauuggucaaagccgcaaugugacauuacaggauuugcaccuuuuuccaaggacaauucgauuaggcuuuccgcugguggggacaucuggguaacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50273 - RNA, 1410 nt, Artificial Sequence
  neuraminidase__InfluenzaA__ADM95729
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagccguagccauuguuuggauccuaacaacgaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50274 - RNA, 1410 nt, Artificial Sequence
  neuraminidase__InfluenzaA__ADM95730
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaagcaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50275 - RNA, 1410 nt, Artificial Sequence
  neuraminidase__InfluenzaA__ADM95732
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcuaugugaaccaacaauaauagaaagaaacauaacagagauaguguaucugaccaacaccaccauagagaaggaaauaugccccaaacuagcagaauacagaaauuggucaaagccgcaaugugacaucacaggauuugcaccuuuuucuaaggacaauucgauuaggcuuuccgcugguggggacauuugggugacgagagaaccuuaugugucaugcgauccugacaaguguuaucaauuugcccuugggcagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaguguuccugcuauccucgauauccuggugucagaugugucugcagagacaauuggaaaggcuccaauaggcccaucguagauauaaacauaaaggaccguagcauuguuuccaguuauguguguucagggcuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaaccauaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcacuucagguacauauggaacaggcucauggccugauggggcggacaucaaucucaugccuauauaa

SEQ ID NO: 50276 - RNA, 1410 nt, Artificial Sequence
  neuraminidase__InfluenzaA__ADM95733
augaauccaaaucaaaagauaauaacgauuggcucuguuucucucaccauuuccacaauaugcuucuucaugcaaauugccauauugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagugagaagucacgcuuaggguaugaaaccuucaaagucauugaaggcugguccaacccuaaguccaaauugcagauaaauaggcaagucauaguugacagagggaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50277 - RNA, 1410 nt, Artificial Sequence; identical to SEQ ID NO: 50276
  neuraminidase__InfluenzaA__ADM95734

SEQ ID NO: 50278 - RNA, 1410 nt, Artificial Sequence
  neuraminidase__InfluenzaA__ADM95735
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50279 - RNA, 1410 nt, Artificial Sequence
  neuraminidase__InfluenzaA__ADM95736
augaauccaaaucaaaagauaauaacgauuggcucuguuucucucaccauuuccacaauaugcuucuucaugcaaauugccauauugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagugagaagucacgcuuaggguaugaaaccuucaaagucauugaaggcugguccaacccuaaguccaaauugcagauaaauaggcaagucauaguugacagagggaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50280 - RNA, 1410 nt, Artificial Sequence
  neuraminidase__InfluenzaA__ADM95737
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaagagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaugucuuguggaccucaaacaguauuguuguguuuuguggcaccucagguacauauggaacaggcucauggccugauggggcggacaucaaucucaugccuauauaa

SEQ ID NO: 50281 - RNA, 1410 nt, Artificial Sequence
  neuraminidase__InfluenzaA__ADM95738
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuauggaccucaaacaguauuguuguguuuuguggcaccucagguacauauggaacaggcucauggccugauggggcggacaucaaucucaugccuauauaa

SEQ ID NO: 50282 - RNA, 1410 nt, Artificial Sequence; identical to SEQ ID NO: 47103
  neuraminidase__InfluenzaA__ADM95739

SEQ ID NO: 50283 - RNA, 1410 nt, Artificial Sequence
  neuraminidase__InfluenzaA__ADM95740
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacgaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacuaaagucuuguggaccucaaacaguauuguuguguuuuguggcaccucagguacauauggaacaggcucauggccugauggggcggacaucaaucucaugccuauauaa

SEQ ID NO: 50284 - RNA, 1410 nt, Artificial Sequence; identical to SEQ ID NO: 50261
  neuraminidase__InfluenzaA__ADM95741

SEQ ID NO: 50285 - RNA, 1410 nt, Artificial Sequence; identical to SEQ ID NO: 50276
  neuraminidase__InfluenzaA__ADM95742

SEQ ID NO: 50286 - RNA, 1410 nt, Artificial Sequence
  neuraminidase__InfluenzaA__ADM95743
augaauccaaaucaaaagauaauaacgauuggcucuguuucucucaccauuuccacaauaugcuucuucaugcaaauugccaucuugauaaccacuguaacauugcauuucaagcaauaugaauucaacuccuccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50287 - RNA, 1410 nt, Artificial Sequence
  neuraminidase__InfluenzaA__ADM95744
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaagagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugagggcaaaagcugcaucaaucggugcuuuuauguggaguugauaaggggaagaaaagaggaaacugaagucuuguggaccucaaacaguauuguuguguuuuguggcaccucagguacauacggaacaggcucauggccugauggggcggacaucaaucucaugccuauauaa

SEQ ID NO: 50288 - RNA, 1410 nt, Artificial Sequence
  neuraminidase__InfluenzaA__ADN05229
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuacccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50289 - RNA, 1413 nt, Artificial Sequence
  neuraminidase__InfluenzaA__ADN06292
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50290 - RNA, 1413 nt, Artificial Sequence
  neuraminidase__InfluenzaA__ADN06303
augaacccaaaucaaaagauaauaaccauuggaucaaucaguauagcaaucggaauaauuagucuaauguugcaaauaggaaguauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgccugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagcagccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguagauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaauugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50291 - RNA, 1413 nt, Artificial Sequence
  neuraminidase__InfluenzaA__ADN06314
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacaucagugacauuggccggcaauucaucucuuuguucuaucaguggaugggcuauauacacaaaagacaacagcauaagaauuggcuccaaaggagagguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacgggauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaacgcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauggugauacugcaaacuggucuuggccagacggugcugaguugccguucaccauugacaaguag

SEQ ID NO: 50292 - RNA, 1413 nt, Artificial Sequence
  neuraminidase__InfluenzaA__ADN06325
augaacccaaaucaaaagauaauaaccauuggaucaaucaguauagcaaucggaauaauuagucuaauguugcaaauaggaaguauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcaguugcaauccagugacuguagauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguggcaauaacugauuggucaggguacagcggaaguuucguccaacauccugaauugacaggauuggacuguauaagaccuugcuucuggguugaguuagucagagggcuaccuagagaaaauacaacaaucuggacuagugggagcagcauuucuuuuuguggcguuaauagugauacugcaaacuggucuuggccagacggugcugaguugccguucaccauugacaaguag

SEQ ID NO: 50293 - RNA, 1413 nt, Artificial Sequence
  neuraminidase__InfluenzaA__ADN06347
augaacccaaaucaaaagauaauaaccauuggaucaaucaguauagcaaucggaauaauuagucuaauguugcaaauaggaaauauuauuucaauaugggcuagucacucaauccaaacugaaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucugcaugaacgggucauguuucacuauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaccaaaugggauacaucugcaguggaguguuuggugacaauccgcgucccgaagauggagagggcagcugcaauccagugaauguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuggucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 50294 - RNA, 1410 nt, Artificial Sequence
  neuraminidase__InfluenzaA__ADN06369
augaauccaaaccaaaagauaauaacgauuggcucuguuucucucaccauuuccacaauaugcuucuucaugcaaauugccaucuugauaacuacuguaacauugcauuucaagcaauauaaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaaugugacauuacgggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucgaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaauuguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 50295 - RNA, 1410 nt, Artificial Sequence; identical to SEQ ID NO: 47242
  neuraminidase__InfluenzaA__ADN26031

SEQ ID NO: 50296 - RNA, 1410 nt, Artificial Sequence; identical to SEQ ID NO: 47242
  neuraminidase__InfluenzaA__ADN26032

SEQ ID NO: 50297 - RNA, 1410 nt, Artificial Sequence; identical to SEQ ID NO: 47242
  neuraminidase__InfluenzaA__ADN26033

SEQ ID NO: 50298 - RNA, 1410 nt, Artificial Sequence; identical to SEQ ID NO: 47441
  neuraminidase__InfluenzaA__ADN26034

SEQ ID NO: 50299 - RNA, 1410 nt, Artificial Sequence; identical to SEQ ID NO: 47242
  neuraminidase__InfluenzaA__ADN26035

SEQ ID NO: 50300 - RNA, 1410 nt, Artificial Sequence; identical to SEQ ID NO: 47242
  neuraminidase__InfluenzaA__ADN26036

SEQ ID NO: 50301 - RNA, 1410 nt, Artificial Sequence
  neuraminidase__InfluenzaA__ADN26037
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggccauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuauugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccggaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50302 - RNA, 1410 nt, Artificial Sequence; identical to SEQ ID NO: 47242
  neuraminidase__InfluenzaA__ADN26038

SEQ ID NO: 50303 - RNA, 1410 nt, Artificial Sequence
  neuraminidase__InfluenzaA__ADN26041
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuauaaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50304 - RNA, 1410 nt, Artificial Sequence
  neuraminidase__InfluenzaA__ADN26042
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuuuuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50305 - RNA, 1410 nt, Artificial Sequence
  neuraminidase__InfluenzaA__ADN26043
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagguaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50306 - RNA, 1410 nt, Artificial Sequence; identical to SEQ ID NO: 47242
  neuraminidase__InfluenzaA__ADN26044

SEQ ID NO: 50307 - RNA, 1410 nt, Artificial Sequence; identical to SEQ ID NO: 47242
  neuraminidase__InfluenzaA__ADN26045

SEQ ID NO: 50308 - RNA, 1410 nt, Artificial Sequence
  neuraminidase__InfluenzaA__ADN26047
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucaaugguuuccgugaaauuaacgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauaucuuuuugugguguaaacagugacacuguggguuggucuuggccagacggugcugaguugccauuuaccauugacaaguaa

SEQ ID NO: 50309 - RNA, 1410 nt, Artificial Sequence; identical to SEQ ID NO: 47242
  neuraminidase__InfluenzaA__ADN26048

SEQ ID NO: 50310 - RNA, 1410 nt, Artificial Sequence; identical to SEQ ID NO: 47242
  neuraminidase__InfluenzaA__ADN26049

SEQ ID NO: 50311 - RNA, 1410 nt, Artificial Sequence; identical to SEQ ID NO: 48833
  neuraminidase__InfluenzaA__ADN26050

SEQ ID NO: 50312 - RNA, 1410 nt, Artificial Sequence; identical to SEQ ID NO: 50304
  neuraminidase__InfluenzaA__ADN26051

SEQ ID NO: 50313 - RNA, 1410 nt, Artificial Sequence; identical to SEQ ID NO: 47242
  neuraminidase__InfluenzaA__ADN26052

SEQ ID NO: 50314 - RNA, 1410 nt, Artificial Sequence
  neuraminidase__InfluenzaA__ADN26053
augaauccaaaccaaaagauaauaaccauugguucggucugcaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcggaaguuuuguucagcauccggaacuaacagggcuggauuguauaagaccuugcuucuggguugaacuaaucagagggcgacccaaagagaacacaaucuggacuagugggagcagcauauccuuuugugguguaaacagugacacuguggguuggucuuggccagacggugcugaguugccauuuaccauugacaaguaa

SEQ ID NO: 50315 - RNA, 1410 nt, Artificial Sequence; identical to SEQ ID NO: 48286
  neuraminidase__InfluenzaA__ADN26054

SEQ ID NO: 50316 - RNA, 1410 nt, Artificial Sequence; identical to SEQ ID NO: 47439
  neuraminidase__InfluenzaA__ADN26057

SEQ ID NO: 50317 - RNA, 1410 nt, Artificial Sequence; identical to SEQ ID NO: 47242
  neuraminidase__InfluenzaA__ADN26058

SEQ ID NO: 50318 - RNA, 1410 nt, Artificial Sequence; identical to SEQ ID NO: 47306
  neuraminidase__InfluenzaA__ADN26059

SEQ ID NO: 50319 - RNA, 1410 nt, Artificial Sequence
  neuraminidase__InfluenzaA__ADN26060
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuggugaaaucacaugugugugcagggauaacuggcauggcucgaaucgaccgugggugucuuucaaccagaaucuggaauaucagauaggauacauaugcagugggauuuucggagacaauccacgcccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50320 - RNA, 1410 nt, Artificial Sequence; identical to SEQ ID NO: 47242
  neuraminidase__InfluenzaA__ADN26061

SEQ ID NO: 50321 - RNA, 1410 nt, Artificial Sequence
  neuraminidase__InfluenzaA__ADN26063
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacacuaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50322 - RNA, 1410 nt, Artificial Sequence; identical to SEQ ID NO: 47439
  neuraminidase__InfluenzaA__ADN26064

SEQ ID NO: 50323 - RNA, 1410 nt, Artificial Sequence
  neuraminidase__InfluenzaA__ADN26065
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggauaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcaugguucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50324 - RNA, 1410 nt, Artificial Sequence; identical to SEQ ID NO: 47306
  neuraminidase__InfluenzaA__ADN26066

SEQ ID NO: 50325 - RNA, 1410 nt, Artificial Sequence
  neuraminidase__InfluenzaA__ADN26067
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccugacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50326 - RNA, 1410 nt, Artificial Sequence; identical to SEQ ID NO: 50325
  neuraminidase__InfluenzaA__ADN26069

SEQ ID NO: 50327 - RNA, 1410 nt, Artificial Sequence
  neuraminidase__InfluenzaA__ADN26070
augaauccaaaccaaaagauaauaaccauugguucagucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50328 - RNA, 1410 nt, Artificial Sequence
  neuraminidase__InfluenzaA__ADN26072
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacaaucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauauaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaauggcucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50329 - RNA, 1410 nt, Artificial Sequence; identical to SEQ ID NO: 47242
  neuraminidase__InfluenzaA__ADN26073

SEQ ID NO: 50330 - RNA, 1410 nt, Artificial Sequence; identical to SEQ ID NO: 47242
  neuraminidase__InfluenzaA__ADN26075

SEQ ID NO: 50331 - RNA, 1410 nt, Artificial Sequence; identical to SEQ ID NO: 47439
  neuraminidase__InfluenzaA__ADN26076

SEQ ID NO: 50332 - RNA, 1410 nt, Artificial Sequence; identical to SEQ ID NO: 47306
  neuraminidase__InfluenzaA__ADN26077

SEQ ID NO: 50333 - RNA, 1410 nt, Artificial Sequence
  neuraminidase__InfluenzaA__ADN26078
augaauccaaaccaaaagauaauaaccauugguucggucuguaugacaauuggaauggcuaacuuaauauuacaaauuggaaacauaaucucaauauggauuagccacucaauucaacuuggaaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50334 - RNA, 1410 nt, Artificial Sequence
  neuraminidase__InfluenzaA__ADN26079
augaauccaaaccaaaagauaauaaccauugguucagucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuuacuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50335 - RNA, 1410 nt, Artificial Sequence; identical to SEQ ID NO: 50327
  neuraminidase__InfluenzaA__ADN26080

SEQ ID NO: 50336 - RNA, 1410 nt, Artificial Sequence; identical to SEQ ID NO: 50333
  neuraminidase__InfluenzaA__ADN26081

SEQ ID NO: 50337 - RNA, 1410 nt, Artificial Sequence; identical to SEQ ID NO: 50333
  neuraminidase__InfluenzaA__ADN26082

SEQ ID NO: 50338 - RNA, 1410 nt, Artificial Sequence; identical to SEQ ID NO: 50333
  neuraminidase__InfluenzaA__ADN26083

SEQ ID NO: 50339 - RNA, 1410 nt, Artificial Sequence; identical to SEQ ID NO: 49942
  neuraminidase__InfluenzaA__ADN26084

SEQ ID NO: 50340 - RNA, 1410 nt, Artificial Sequence; identical to SEQ ID NO: 47306
  neuraminidase__InfluenzaA__ADN26085

SEQ ID NO: 50341 - RNA, 1410 nt, Artificial Sequence; identical to SEQ ID NO: 48831
  neuraminidase__InfluenzaA__ADN26086

SEQ ID NO: 50342 - RNA, 1410 nt, Artificial Sequence; identical to SEQ ID NO: 47242
  neuraminidase__InfluenzaA__ADN26087

SEQ ID NO: 50343 - RNA, 1410 nt, Artificial Sequence; identical to SEQ ID NO: 47242
  neuraminidase__InfluenzaA__ADN26088

SEQ ID NO: 50344 - RNA, 1410 nt, Artificial Sequence; identical to SEQ ID NO: 48269
  neuraminidase__InfluenzaA__ADN26090

SEQ ID NO: 50345 - RNA, 1410 nt, Artificial Sequence; identical to SEQ ID NO: 47686
  neuraminidase__InfluenzaA__ADN26091

SEQ ID NO: 50346 - RNA, 1410 nt, Artificial Sequence; identical to SEQ ID NO: 50327
  neuraminidase__InfluenzaA__ADN26092

SEQ ID NO: 50347 - RNA, 1410 nt, Artificial Sequence; identical to SEQ ID NO: 50327
  neuraminidase__InfluenzaA__ADN26093

SEQ ID NO: 50348 - RNA, 1410 nt, Artificial Sequence
  neuraminidase__InfluenzaA__ADN26094
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggaaagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50349 - RNA, 1410 nt, Artificial Sequence; identical to SEQ ID NO: 49942
  neuraminidase__InfluenzaA__ADN26095

SEQ ID NO: 50350 - RNA, 1410 nt, Artificial Sequence
  neuraminidase__InfluenzaA__ADN26096
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaauggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaaacauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 50351 - RNA, 1410 nt, Artificial Sequence
  neuraminidase__InfluenzaA__ADN26097
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaauaccaacuuugcugcuggacagucagugguuuccgugaaauuggcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcaugugugaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguagggauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50352 - RNA, 1410 nt, Artificial Sequence; identical to SEQ ID NO: 47439
  neuraminidase__InfluenzaA__ADN26098

SEQ ID NO: 50353 - RNA, 1410 nt, Artificial Sequence; identical to SEQ ID NO: 47439
  neuraminidase__InfluenzaA__ADN26099

SEQ ID NO: 50354 - RNA, 1410 nt, Artificial Sequence; identical to SEQ ID NO: 47439
  neuraminidase__InfluenzaA__ADN26100

SEQ ID NO: 50355 - RNA, 1410 nt, Artificial Sequence; identical to SEQ ID NO: 47439
  neuraminidase__InfluenzaA__ADN26101

SEQ ID NO: 50356 - RNA, 1410 nt, Artificial Sequence
  neuraminidase__InfluenzaA__ADN26102
augaauccaaaccaaaagauaauaaccauugguucggucuguaugacaauuggaauggcuaacuuaauauuacaaauuggaaacauaaucucaauauggauuagccacuuaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggagccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaaaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaugguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacucaaucuggacuagcgggagcagcauauccuuuugugguguaaacagugacacuguggguuggucuuggccggacggugcugaguugccauuuaccauugacaaguaa

SEQ ID NO: 50357 - RNA, 1410 nt, Artificial Sequence; identical to SEQ ID NO: 49025
  neuraminidase__InfluenzaA__ADN26103

SEQ ID NO: 50358 - RNA, 1410 nt, Artificial Sequence; identical to SEQ ID NO: 47439
  neuraminidase__InfluenzaA__ADN26104

SEQ ID NO: 50359 - RNA, 1410 nt, Artificial Sequence; identical to SEQ ID NO: 47439
  neuraminidase__InfluenzaA__ADN26105

SEQ ID NO: 50360 - RNA, 1410 nt, Artificial Sequence; identical to SEQ ID NO: 50327
  neuraminidase__InfluenzaA__ADN26106

SEQ ID NO: 50361 - RNA, 1410 nt, Artificial Sequence; identical to SEQ ID NO: 49942
  neuraminidase__InfluenzaA__ADN26107

SEQ ID NO: 50362 - RNA, 1410 nt, Artificial Sequence; identical to SEQ ID NO: 49942
  neuraminidase__InfluenzaA__ADN26108

SEQ ID NO: 50363 - RNA, 1410 nt, Artificial Sequence; identical to SEQ ID NO: 47439
  neuraminidase__InfluenzaA__ADN26109

SEQ ID NO: 50364 - RNA, 1410 nt, Artificial Sequence
  neuraminidase__InfluenzaA__ADN26110
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaauggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 50365 - RNA, 1410 nt, Artificial Sequence; identical to SEQ ID NO: 49942
  neuraminidase__InfluenzaA__ADN26111

SEQ ID NO: 50366 - RNA, 1410 nt, Artificial Sequence; identical to SEQ ID NO: 50364
  neuraminidase__InfluenzaA__ADN26112

SEQ ID NO: 50367 - RNA, 1410 nt, Artificial Sequence
  neuraminidase__InfluenzaA__ADN26113
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggagccauucauaucaugcucccccuuggaaugcagaaccuucuucuugacucaaggggccuugcuaaaugacaaacauuccaauggaaccauuaaagacaggagcccauaucgaacucuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaaaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaugguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 50368 - RNA, 1410 nt, Artificial Sequence
  neuraminidase__InfluenzaA__ADN26114
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucaacaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50369 - RNA, 1410 nt, Artificial Sequence; identical to SEQ ID NO: 47439
  neuraminidase__InfluenzaA__ADN26115

SEQ ID NO: 50370 - RNA, 1410 nt, Artificial Sequence
  neuraminidase__InfluenzaA__ADN26116
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaauggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccguggguaucuuucaaccagaaucuggaauaucagauaggauacauaugcagugggauuuucggagacaauccacgcccuaaugauaagacaggcaguugugguccagugucgucuaauggagcaaacggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacaaggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 50371 - RNA, 1410 nt, Artificial Sequence
  neuraminidase__InfluenzaA__ADN26117
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggagccauucauaucaugcucccccuuggaaugcagaaccuucuucuugacucaaggggccuugcuaaaugacaaacauuccaauggaaccauuaaagacaggagcccauaucgaacucuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaaaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaugguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauaucauuuugugguguaaacagugacacuguggguuggucuuggccggacggugcugaguugccauuuaccauugacaaguaa

SEQ ID NO: 50372 - RNA, 1410 nt, Artificial Sequence; identical to SEQ ID NO: 49942
  neuraminidase__InfluenzaA__ADN26118

SEQ ID NO: 50373 - RNA, 1410 nt, Artificial Sequence; identical to SEQ ID NO: 47707
  neuraminidase__InfluenzaA__ADN26119

SEQ ID NO: 50374 - RNA, 1410 nt, Artificial Sequence; identical to SEQ ID NO: 50364
  neuraminidase__InfluenzaA__ADN26120

SEQ ID NO: 50375 - RNA, 1410 nt, Artificial Sequence; identical to SEQ ID NO: 49942
  neuraminidase__InfluenzaA__ADN26121

SEQ ID NO: 50376 - RNA, 1410 nt, Artificial Sequence; identical to SEQ ID NO: 47439
  neuraminidase__InfluenzaA__ADN26122

SEQ ID NO: 50377 - RNA, 1410 nt, Artificial Sequence; identical to SEQ ID NO: 47707
  neuraminidase__InfluenzaA__ADN26123

SEQ ID NO: 50378 - RNA, 1410 nt, Artificial Sequence; identical to SEQ ID NO: 47439
  neuraminidase__InfluenzaA__ADN26124

SEQ ID NO: 50379 - RNA, 1410 nt, Artificial Sequence; identical to SEQ ID NO: 50364
  neuraminidase__InfluenzaA__ADN26125

SEQ ID NO: 50380 - RNA, 1410 nt, Artificial Sequence; identical to SEQ ID NO: 50364
  neuraminidase__InfluenzaA__ADN26126

SEQ ID NO: 50381 - RNA, 1410 nt, Artificial Sequence
  neuraminidase__InfluenzaA__ADN26127
augaauccaaaccaaaagauaauaaccauugguucggucuguaugacaauuggaauggcuaacuuaauauuacaaauuggaaacauaaucucaauauggauuagccacucaauucaacuugggaaucaaaaucagauuggaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucaguugcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50382 - RNA, 1410 nt, Artificial Sequence; identical to SEQ ID NO: 47439
  neuraminidase__InfluenzaA__ADN26128

SEQ ID NO: 50383 - RNA, 1410 nt, Artificial Sequence; identical to SEQ ID NO: 50364
  neuraminidase__InfluenzaA__ADN26129

SEQ ID NO: 50384 - RNA, 1410 nt, Artificial Sequence; identical to SEQ ID NO: 49942
  neuraminidase__InfluenzaA__ADN26130

SEQ ID NO: 50385 - RNA, 1410 nt, Artificial Sequence
  neuraminidase__InfluenzaA__ADN26131
augaauccaaaccaaaagauaauaaccauugguucggucuguaugacaauuggaauggcuaacuuaauauuacaaauuggaaacauaaucucaauauggauuagccacucaauucaacuugggaaucaaaaccagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauaucccuuugugguguaaacagugacacuguggguuggucuuggccagacggugcugaguugccauuuaccauugacaaguaa

SEQ ID NO: 50386 - RNA, 1410 nt, Artificial Sequence; identical to SEQ ID NO: 49942
  neuraminidase__InfluenzaA__ADN26132

SEQ ID NO: 50387 - RNA, 1410 nt, Artificial Sequence; identical to SEQ ID NO: 50364
  neuraminidase__InfluenzaA__ADN26134

SEQ ID NO: 50388 - RNA, 1410 nt, Artificial Sequence; identical to SEQ ID NO: 47306
  neuraminidase__InfluenzaA__ADN26135

SEQ ID NO: 50389 - RNA, 1410 nt, Artificial Sequence
  neuraminidase__InfluenzaA__ADN26136
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaauaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50390 - RNA, 1410 nt, Artificial Sequence
  neuraminidase__InfluenzaA__ADN26137
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaauaccaacuuugcugcuggacagucagugguuuccgugaaauuggcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcauaaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguagggauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50391 - RNA, 1410 nt, Artificial Sequence
  neuraminidase__InfluenzaA__ADN26138
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggagccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaaaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugacaagacaggcaguugugguccaguaucgucuaauggagcaaauggaguaaaaggauuuucauucaaauacggcaaugguguuuggauagggagaacuaaaagcauuaguucaagaaaugguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 50392 - RNA, 1410 nt, Artificial Sequence
  neuraminidase__InfluenzaA__ADN26140
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaauggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaacggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 50393 - RNA, 1410 nt, Artificial Sequence
  neuraminidase__InfluenzaA__ADN26141
augaauccaaaccaaaagauaauaaccauugguucggucuguaugacaauuggaauggcuaacuuaauauuacaaauuggaaacauaaucucaauauggauuagccacucaauucaacuugggaaucaaaaucggauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50394 - RNA, 1410 nt, Artificial Sequence
  neuraminidase__InfluenzaA__ADN26142
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaacaacuuugcugcuggacagucagugguuuccgugaaauuagcgggcaauuccucucucugcccuguuaauggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaacggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 50395 - RNA, 1410 nt, Artificial Sequence; identical to SEQ ID NO: 47439
  neuraminidase__InfluenzaA__ADN26143

SEQ ID NO: 50396 - RNA, 1410 nt, Artificial Sequence; identical to SEQ ID NO: 49942
  neuraminidase__InfluenzaA__ADN26144

SEQ ID NO: 50397 - RNA, 1410 nt, Artificial Sequence; identical to SEQ ID NO: 49942
  neuraminidase__InfluenzaA__ADN26145

SEQ ID NO: 50398 - RNA, 1410 nt, Artificial Sequence
  neuraminidase__InfluenzaA__ADN26146
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50399 - RNA, 1410 nt, Artificial Sequence; identical to SEQ ID NO: 49942
  neuraminidase__InfluenzaA__ADN26147

SEQ ID NO: 50400 - RNA, 1410 nt, Artificial Sequence; identical to SEQ ID NO: 47707
  neuraminidase__InfluenzaA__ADN26148

SEQ ID NO: 50401 - RNA, 1410 nt, Artificial Sequence; identical to SEQ ID NO: 49942
  neuraminidase__InfluenzaA__ADN26149

SEQ ID NO: 50402 - RNA, 1410 nt, Artificial Sequence
  neuraminidase__InfluenzaA__ADN26150
augaauccaaaccaaaagauaauaaccauugguucggucuguaugacaauuggaauggcuagcuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50403 - RNA, 1410 nt, Artificial Sequence
  neuraminidase__InfluenzaA__ADN26151
augaauccaaaccaaaagauaauaaccauugguucggucuguaugacaauuggaauggcuaacuuaauauuacaaauuggaaacauaaucucaauauggauuagccauucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaauggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 50404 - RNA, 1410 nt, Artificial Sequence
  neuraminidase__InfluenzaA__ADN26152
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccaugaaauuagcgggcaauuccucucucugcccuguuaauggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaaaauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacuaggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 50405 - RNA, 1410 nt, Artificial Sequence; identical to SEQ ID NO: 49942
  neuraminidase__InfluenzaA__ADN26153

SEQ ID NO: 50406 - RNA, 1410 nt, Artificial Sequence; identical to SEQ ID NO: 50025
  neuraminidase__InfluenzaA__ADN26154

SEQ ID NO: 50407 - RNA, 1410 nt, Artificial Sequence
  neuraminidase__InfluenzaA__ADN26155
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucucccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50408 - RNA, 1410 nt, Artificial Sequence; identical to SEQ ID NO: 50392
  neuraminidase__InfluenzaA__ADN26157

SEQ ID NO: 50409 - RNA, 1410 nt, Artificial Sequence; identical to SEQ ID NO: 47439
  neuraminidase__InfluenzaA__ADN26159

SEQ ID NO: 50410 - RNA, 1410 nt, Artificial Sequence
  neuraminidase__InfluenzaA__ADN26161
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggugacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50411 - RNA, 1410 nt, Artificial Sequence
  neuraminidase__InfluenzaA__ADN26162
augaauccaaaccaaaagauaauaaccauuaguucggucuguaugacaguuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50412 - RNA, 1410 nt, Artificial Sequence
  neuraminidase__InfluenzaA__ADN26163
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucauaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaucauugacaaguaa

SEQ ID NO: 50413 - RNA, 1410 nt, Artificial Sequence
  neuraminidase__InfluenzaA__ADN26164
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagaccggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcaugucuaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaaugacuucucaauaaagcaagauaucguaggaauaaaugaguggucaggauauagcgggaguuuuguucagcauccagaacuaacagggcuggauuguauaagaccuugcuucuggguugaauuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50414 - RNA, 1410 nt, Artificial Sequence; identical to SEQ ID NO: 49199
  neuraminidase__InfluenzaA__ADN26168

SEQ ID NO: 50415 - RNA, 1410 nt, Artificial Sequence; identical to SEQ ID NO: 48465
  neuraminidase__InfluenzaA__ADN26178

SEQ ID NO: 50416 - RNA, 1410 nt, Artificial Sequence; identical to SEQ ID NO: 47242
  neuraminidase__InfluenzaA__ADN26868

SEQ ID NO: 50417 - RNA, 1410 nt, Artificial Sequence; identical to SEQ ID NO: 47242
  neuraminidase__InfluenzaA__ADN26869

SEQ ID NO: 50418 - RNA, 1410 nt, Artificial Sequence
  neuraminidase__InfluenzaA__ADN26870
augaauccaaaccaaaagauaauaaccauugguucggucuguaugacaauuggaauggcuaacuuaauauuacaaauuggaaacauaaucucaauauggauuagccacucaauucaacuuggaaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacucuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50419 - RNA, 1410 nt, Artificial Sequence
  neuraminidase__InfluenzaA__ADN26871
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacauacaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucgggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50420 - RNA, 1410 nt, Artificial Sequence
  neuraminidase__InfluenzaA__ADN26872
augaauccaaaccaaaagauaauaaccauugguucggucuguaugacaauuggaauggcuaacuuaauauuacaaauuggaaacauaauuucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcugggcugucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacucuaaugagcuguccuauuggugaaguucccucuccauacaacucaagauuugagucagucgcuuggucagcaagugcuugucaugauggcaucaguuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50421 - RNA, 1410 nt, Artificial Sequence
  neuraminidase__InfluenzaA__ADN26873
augaauccaaaccaaaagauaauaaccaucgguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucgggauauagcgggaguuuuguucagcauccagaauuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50422 - RNA, 1410 nt, Artificial Sequence
  neuraminidase__InfluenzaA__ADN26874
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguauggauagggagaacuaaaagcauuaguucaagaaacgguuuugagaugauuugggauccgaacggauggacugggacagacaauaacuucucaauaaagcaagauaucguaggaauaaaugaguggucgggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50423 - RNA, 1410 nt, Artificial Sequence
  neuraminidase__InfluenzaA__ADN26875
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguugaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucgggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50424 - RNA, 1410 nt, Artificial Sequence; identical to SEQ ID NO: 50421
  neuraminidase__InfluenzaA__ADN26876

SEQ ID NO: 50425 - RNA, 1410 nt, Artificial Sequence
  neuraminidase__InfluenzaA__ADN26877
augaauccaaaccaaaagauaauaaccaucgguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggcauugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucgggauauagcgggaguuuuguucagcauccagaauuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50426 - RNA, 1410 nt, Artificial Sequence; identical to SEQ ID NO: 48286
  neuraminidase__InfluenzaA__ADN26878

SEQ ID NO: 50427 - RNA, 1410 nt, Artificial Sequence
  neuraminidase__InfluenzaA__ADN26879
augaauccaaaccaaaagauaauaaccauugguucggucuguaugacaauuggaauggcuaacuuaauauuacaaauuggaaacauaaucucaauauggauuagccacucaauucaacuuggaaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaauucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50428 - RNA, 1410 nt, Artificial Sequence
  neuraminidase__InfluenzaA__ADN26880
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucgggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50429 - RNA, 1410 nt, Artificial Sequence; identical to SEQ ID NO: 50428
  neuraminidase__InfluenzaA__ADN26881

SEQ ID NO: 50430 - RNA, 1410 nt, Artificial Sequence; identical to SEQ ID NO: 50239
  neuraminidase__InfluenzaA__ADN26882

SEQ ID NO: 50431 - RNA, 1410 nt, Artificial Sequence; identical to SEQ ID NO: 50421
  neuraminidase__InfluenzaA__ADN26883

SEQ ID NO: 50432 - RNA, 1413 nt, Artificial Sequence
  neuraminidase__InfluenzaA__ADN89064
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauacguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaggggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 50433 - RNA, 1413 nt, Artificial Sequence
  neuraminidase__InfluenzaA__ADN89075
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcaucagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugacugauggcccgaguaacaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagaggguagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 50434 - RNA, 1413 nt, Artificial Sequence
  neuraminidase__InfluenzaA__ADN89086
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggcgaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaagaccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccaguaacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50435 - RNA, 1413 nt, Artificial Sequence
  neuraminidase__InfluenzaA__ADN89097
augaacccaaaucaaaagauaauaaccauuggaucaaucaguauagcaaucggaauaaucagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50436 - RNA, 1413 nt, Artificial Sequence
  neuraminidase__InfluenzaA__ADN89108
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggauccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuagauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguaucaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuugugguguuaauagugauacugcaaacuggucuuggccagacggugcugaguugccguucaccauugacaaguag

SEQ ID NO: 50437 - RNA, 1413 nt, Artificial Sequence
  neuraminidase__InfluenzaA__ADN89119
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuacgaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguuaauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguacaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50438 - RNA, 1413 nt, Artificial Sequence
  neuraminidase__InfluenzaA__ADN89130
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaauuucgaaucaguugcauggucagcaagcgcaugccaugauggcaugggcugguuaacaaucggaauuucugguccagacaauggagcuguggcuguacuaaaauacaacgggauaauaacuggaaccauaaaaaguuggaaaaagcaaaucuuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaacgcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauggugauacugcaaacuggucuuggccagacggugcugaguugccguucaccauugacaaguag

SEQ ID NO: 50439 - RNA, 1413 nt, Artificial Sequence; identical to SEQ ID NO: 50436
  neuraminidase__InfluenzaA__ADN89141

SEQ ID NO: 50440 - RNA, 1413 nt, Artificial Sequence
  neuraminidase__InfluenzaA__ADN89152
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaagacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcccuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuauugauggagcaaacggaguaaaaggguuuucauacaaauaugguaaugggguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 50441 - RNA, 1413 nt, Artificial Sequence
  neuraminidase__InfluenzaA__ADN89163
augaacccaaaucaaaggauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucauacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccgcaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccggugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacacccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50442 - RNA, 1413 nt, Artificial Sequence
  neuraminidase__InfluenzaA__ADN89174
augaacccaaaucaaaagauaauaaccauuggaucaaucaguauagcaaucggaauaauuagucuaauguugcaaauaggaaguauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggcuggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguagauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaauugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50443 - RNA, 1413 nt, Artificial Sequence; identical to SEQ ID NO: 50436
  neuraminidase__InfluenzaA__ADN89185

SEQ ID NO: 50444 - RNA, 1413 nt, Artificial Sequence
  neuraminidase__InfluenzaA__ADN89196
augaacccaaaucaaaagauaauaaccauuggaucaaucaguauagcaaucggaauaauuagucuaauguugcaaauaggaaguauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaaugggauacaucugcaguggaguguuuggugacaauccgcgucccgaagauggagagggcagcugcaauccagugacuguagauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucauugaagcaggauguuguagcaauaacugauuggucaggguacagcggaaguuucguccaacauccugaauugacaggauuggacuguauaagaccuugcuucuggguugaguuagucagagggcugccuagagaaaauacaacaaucuggaccagugggagcagcauuucuuuuuguggcguuaauagugauacugcaaacuggucuuggccagacggugcugaguugccguucaccauugacaaguag

SEQ ID NO: 50445 - RNA, 1413 nt, Artificial Sequence; identical to SEQ ID NO: 50444
  neuraminidase__InfluenzaA__ADN89207

SEQ ID NO: 50446 - RNA, 1413 nt, Artificial Sequence
  neuraminidase__InfluenzaA__ADN89218
augaacccaaaucaaaagauaauaaccauuggaucaaucaguauagcaaucggaauaauuagucuaauguugcaaauaggaaauauuauuucaauaugggcuagucacucaauccaaccugggagucaaaacaacacuggaauaugcaaccaaagaaucaucacauaugaaaacagcaccugggugaaucacacauauguuaacauuaacaacacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacgggauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaacgcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauggugauacugcaaacuggucuuggccagacggugcugaguugccguucaccauugacaaguag

SEQ ID NO: 50447 - RNA, 1413 nt, Artificial Sequence
  neuraminidase__InfluenzaA__ADN89229
augaacccaaaucaaaagauaauaaccauuggaucaaucaguauagcaaucggaauaauuagucuaauguuacaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuugaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacugggaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggacccuaauggauggacaaauaccgacagugauuucucagugaaacaggauguuguagcaacaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 50448 - RNA, 1413 nt, Artificial Sequence
  neuraminidase__InfluenzaA__ADN89240
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacgggauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaacgcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaaggccuugcuucuggguugaguuagucagagggcugccuagagaaaauacaacaaucuggacuagugggagcagcauuucuuuuuguggcguuaauggugauacugcaaacuggucuuggccagacggugcugaguugccguucaccauugacaaguag

SEQ ID NO: 50449 - RNA, 1413 nt, Artificial Sequence; identical to SEQ ID NO: 49911
  neuraminidase__InfluenzaA__ADN89251

SEQ ID NO: 50450 - RNA, 1413 nt, Artificial Sequence
  neuraminidase__InfluenzaA__ADN89262
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggcgaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcguccugaagauggagagggcagcugcaauccaguaacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50451 - RNA, 1413 nt, Artificial Sequence
  neuraminidase__InfluenzaA__ADN89273
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauacguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 50452 - RNA, 1413 nt, Artificial Sequence; identical to SEQ ID NO: 50451
  neuraminidase__InfluenzaA__ADN89284

SEQ ID NO: 50453 - RNA, 1413 nt, Artificial Sequence; identical to SEQ ID NO: 50451
  neuraminidase__InfluenzaA__ADN89295

SEQ ID NO: 50454 - RNA, 1413 nt, Artificial Sequence; identical to SEQ ID NO: 50451
  neuraminidase__InfluenzaA__ADN89306

SEQ ID NO: 50455 - RNA, 1413 nt, Artificial Sequence
  neuraminidase__InfluenzaA__ADN89317
augaacccaaaucaaaggauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaauuaucacauaugaaaacagcacuugggugaaucacacauauguuaauauuaacagcacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauggugauacugcaaacuggucuuggccagacggugcugaguugccguucaccauugacaaguag

SEQ ID NO: 50456 - RNA, 1413 nt, Artificial Sequence
  neuraminidase__InfluenzaA__ADN89328
augaacccaaaucaaaagauaauaaccauuggaucaaucaguauagcaaucggaauaauuagucuaauguugcaaauaggaaguauuauuucaauaugggcuagucacucaauccaaacuggaagucaaaacaacacuggaauaugcaaccaaagaaucaucacauaugaaaauagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucugggcuagugggagcagcauuucuuuuuguggcguuaauagugauacugcaaacuggucuuggccagacggugcugaguugccguucaccauugacaaguag

SEQ ID NO: 50457 - RNA, 1413 nt, Artificial Sequence; identical to SEQ ID NO: 50441
  neuraminidase__InfluenzaA__ADN89339

SEQ ID NO: 50458 - RNA, 1413 nt, Artificial Sequence; identical to SEQ ID NO: 50447
  neuraminidase__InfluenzaA__ADN89350

SEQ ID NO: 50459 - RNA, 1413 nt, Artificial Sequence
  neuraminidase__InfluenzaA__ADN89361
augaacccaaaucaaaagauaauaaccauuggaucaaucaguauagcaaucggaauaauuagucuaauguugcaaauaggaaguauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuuaucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugucaugauggcaugggcugguuaacaaucggaauuuccgguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50460 - RNA, 1413 nt, Artificial Sequence
  neuraminidase__InfluenzaA__ADN89372
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauauuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguuaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuacgaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguuaauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50461 - RNA, 1413 nt, Artificial Sequence; identical to SEQ ID NO: 50436
  neuraminidase__InfluenzaA__ADN89383

SEQ ID NO: 50462 - RNA, 1413 nt, Artificial Sequence
  neuraminidase__InfluenzaA__ADN89405
augaacccaaaucaaaagauaauaaccauuggaucaaucaguauagcaaucggaauaauuagucuaauguugcaaauaggaaguauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaccagugggugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccggacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguagauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaauugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50463 - RNA, 1413 nt, Artificial Sequence
  neuraminidase__InfluenzaA__ADN89416
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacgggauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaacgcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggagugcuuggugacaauccgcgucccgaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauggugauacugcaaacuggucuuggccagacggugcugaguugccguucaccauugacaaguag

SEQ ID NO: 50464 - RNA, 1413 nt, Artificial Sequence
  neuraminidase__InfluenzaA__ADN89427
augaacccaaaucaaaagauaauaaccauuggaucaaucaguauagcaauuggaauaauuagucuaauguugcaaauaggaaguauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaggauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagcgggagcagcauuucuuuuuguggcguugauagugaugcugcagacuggucuuggccagacggugcugaguugccguucaccauugacaaguag

SEQ ID NO: 50465 - RNA, 1413 nt, Artificial Sequence; identical to SEQ ID NO: 50289
  neuraminidase__InfluenzaA__ADN89438

SEQ ID NO: 50466 - RNA, 1413 nt, Artificial Sequence
  neuraminidase__InfluenzaA__ADN89449
augaacccaaaucaaaagauaauaaccauuggaucaaucaguauagcaaucggaauaauuagucuaauguugcaaauaggaaauauuauuucaauaugggcuagucauucaauccaaacuggaagucaaaacaacacuggaauaugcaaccaaagaaucaucacauaugaaaacagcaccugggugaaucacacauauguuaauauuaacaacacuaauguuguugcuggagaggacaaaccaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaacauuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgcuucauacaaaauuuucaagaucgaaaaggggaaggucacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50467 - RNA, 1413 nt, Artificial Sequence; identical to SEQ ID NO: 50442
  neuraminidase__InfluenzaA__ADN89460

SEQ ID NO: 50468 - RNA, 1413 nt, Artificial Sequence; identical to SEQ ID NO: 50433
  neuraminidase__InfluenzaA__ADN89482

SEQ ID NO: 50469 - RNA, 1413 nt, Artificial Sequence
  neuraminidase__InfluenzaA__ADN89493
augaacccaaaucaaaagauaauaaccauuggaucaaucaguauagcaaucggaauaauuagucuaauguugcaaauaggaaauauuauuucaauaugggcuagucacucaauccaaacugaaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucugcaugaacgggucauguuucacuauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaccaaaugggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuggucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 50470 - RNA, 1413 nt, Artificial Sequence; identical to SEQ ID NO: 49911
  neuraminidase__InfluenzaA__ADN89504

SEQ ID NO: 50471 - RNA, 1413 nt, Artificial Sequence
  neuraminidase__InfluenzaA__ADN89515
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggcgaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccaguaacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucacagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50472 - RNA, 1413 nt, Artificial Sequence
  neuraminidase__InfluenzaA__ADN89526
augaacccaaaucaaaagauaauaaccauuggaucaaucaguauagcaaucggaauaauuagucuaauguuacaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuugaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacugggaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 50473 - RNA, 1413 nt, Artificial Sequence; identical to SEQ ID NO: 50436
  neuraminidase__InfluenzaA__ADN89537

SEQ ID NO: 50474 - RNA, 1413 nt, Artificial Sequence; identical to SEQ ID NO: 50289
  neuraminidase__InfluenzaA__ADN89548

SEQ ID NO: 50475 - RNA, 1413 nt, Artificial Sequence; identical to SEQ ID NO: 50433
  neuraminidase__InfluenzaA__ADN89570

SEQ ID NO: 50476 - RNA, 1413 nt, Artificial Sequence
  neuraminidase__InfluenzaA__ADN89581
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacgggauaauaacuggaaccauaaaaaguuggaaaaagcaaauauuaagaacacaagagucugaaugugucuguaugaacgggucauguuucaccauaaugaccgauggcccgaguaauaagaccgccucguacaaaauuuucaagaucgaaaaggggaagguuacuaaaucaauagaguugaacgcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggguuggacuguauaagaccuugcuucuggguugaguuagucagagggcugccuagagaaaauacaacaaucuggacuagugggagcagcauuucuuuuuguggcguuaauggugauacugcaaacuggucuuggccagacggugcugaguugccguucaccauugacaaguag

SEQ ID NO: 50477 - RNA, 1413 nt, Artificial Sequence
  neuraminidase__InfluenzaA__ADN89592
augaacccaaaucaaaagauaauaaccauuggaucaaucaguauagcaaucggaauaauuagucuaauguugcaaauaggaaguauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagcagccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguagauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaauugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50478 - RNA, 1413 nt, Artificial Sequence
  neuraminidase__InfluenzaA__ADN89603
augaacccaaaucaaaagauaauaaccauuggaucaaucaguauagcaaucggaauaauuagucuaauguugcaaauaggaaguauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccacgucccgaagauggagagggcagcugcaauccagugacuguagauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguggcaauaacugauuggucaggguacagcggaaguuucguccaacauccugaauugacaggauuggacuguauaagaccuugcuucuggguugaguuagucagagggcuaccuagagaaaauacaacaaucuggacuagugggagcagcauuucuuuuuguggcguuaauagugauacugcaaacuggucuuggccagacggugcugaguugccguucaccauugacaaguag

SEQ ID NO: 50479 - RNA, 1413 nt, Artificial Sequence; identical to SEQ ID NO: 50444
  neuraminidase__InfluenzaA__ADN89614

SEQ ID NO: 50480 - RNA, 1413 nt, Artificial Sequence; identical to SEQ ID NO: 50463
  neuraminidase__InfluenzaA__ADN89625

SEQ ID NO: 50481 - RNA, 1413 nt, Artificial Sequence; identical to SEQ ID NO: 50289
  neuraminidase__InfluenzaA__ADN89636

SEQ ID NO: 50482 - RNA, 1413 nt, Artificial Sequence; identical to SEQ ID NO: 49911
  neuraminidase__InfluenzaA__ADN89647

SEQ ID NO: 50483 - RNA, 1413 nt, Artificial Sequence; identical to SEQ ID NO: 50289
  neuraminidase__InfluenzaA__ADN89658

SEQ ID NO: 50484 - RNA, 1413 nt, Artificial Sequence; identical to SEQ ID NO: 50477
  neuraminidase__InfluenzaA__ADN89669

SEQ ID NO: 50485 - RNA, 1413 nt, Artificial Sequence; identical to SEQ ID NO: 49439
  neuraminidase__InfluenzaA__ADN89680

SEQ ID NO: 50486 - RNA, 1413 nt, Artificial Sequence; identical to SEQ ID NO: 50450
  neuraminidase__InfluenzaA__ADN89691

SEQ ID NO: 50487 - RNA, 1413 nt, Artificial Sequence; identical to SEQ ID NO: 50463
  neuraminidase__InfluenzaA__ADN89702

SEQ ID NO: 50488 - RNA, 1413 nt, Artificial Sequence; identical to SEQ ID NO: 50433
  neuraminidase__InfluenzaA__ADN89713

SEQ ID NO: 50489 - RNA, 1413 nt, Artificial Sequence; identical to SEQ ID NO: 49911
  neuraminidase__InfluenzaA__ADN89724

SEQ ID NO: 50490 - RNA, 1413 nt, Artificial Sequence; identical to SEQ ID NO: 50433
  neuraminidase__InfluenzaA__ADN89735

SEQ ID NO: 50491 - RNA, 1413 nt, Artificial Sequence; identical to SEQ ID NO: 50433
  neuraminidase__InfluenzaA__ADN89746

SEQ ID NO: 50492 - RNA, 1413 nt, Artificial Sequence
  neuraminidase__InfluenzaA__ADN89757
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaauguuccuguuacccagauacuggcauagugauguguguaugcagggacaacuggcaugguucaaaucgaccuugggugucuuuuaaucaaaacuuggauuaucaaauaggauacauuugcaguggaguguuuggugacaauccgcgucccgaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuuuucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50493 - RNA, 1413 nt, Artificial Sequence; identical to SEQ ID NO: 50451
  neuraminidase__InfluenzaA__ADN89768

SEQ ID NO: 50494 - RNA, 1413 nt, Artificial Sequence
  neuraminidase__InfluenzaA__ADN89779
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuauugauggagcaaacggaguaaaaggguuuucauacaaauaugguaaugggguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 50495 - RNA, 1413 nt, Artificial Sequence; identical to SEQ ID NO: 49439
  neuraminidase__InfluenzaA__ADN89790

SEQ ID NO: 50496 - RNA, 1413 nt, Artificial Sequence
  neuraminidase__InfluenzaA__ADN89801
augaacccaaaucaaaagauaauaaccauuggaucaaucaguauagcaaucggaacaauuagucuaauguuacaaauaggaaauauuauuucaauaugggcuagucacucaauccaaacuggaagucaaaacaacacuggaauaugcaaccaaagaaucaucacauauaaaaacagcaccugggugaaucacacguauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuugaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacugggaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 50497 - RNA, 1413 nt, Artificial Sequence
  neuraminidase__InfluenzaA__ADN89823
augaacccaaaucaaaagauaauaaccauuggaucaaucaguauagcaaucggaauaauuagucuaauguugcaaauaggaaguauuauuucaauaugggcuagucacucaauccauacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccauccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguagauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaauugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucacuauugacaaguag

SEQ ID NO: 50498 - RNA, 1413 nt, Artificial Sequence; identical to SEQ ID NO: 50442
  neuraminidase__InfluenzaA__ADN89834

SEQ ID NO: 50499 - RNA, 1413 nt, Artificial Sequence
  neuraminidase__InfluenzaA__ADN89845
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaagggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuagauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguaucaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuugugguguuaauagugauacugcaaacuggucuuggccagacggugcugaguugccguucaccauugacaaguag

SEQ ID NO: 50500 - RNA, 1413 nt, Artificial Sequence; identical to SEQ ID NO: 50472
  neuraminidase__InfluenzaA__ADN89856

SEQ ID NO: 50501 - RNA, 1410 nt, Artificial Sequence; identical to SEQ ID NO: 49914
  neuraminidase__InfluenzaA__ADN89867

SEQ ID NO: 50502 - RNA, 1410 nt, Artificial Sequence; identical to SEQ ID NO: 49914
  neuraminidase__InfluenzaA__ADN89878

SEQ ID NO: 50503 - RNA, 1410 nt, Artificial Sequence; identical to SEQ ID NO: 49914
  neuraminidase__InfluenzaA__ADN89889

SEQ ID NO: 50504 - RNA, 1410 nt, Artificial Sequence; identical to SEQ ID NO: 49914
  neuraminidase__InfluenzaA__ADN89900

SEQ ID NO: 50505 - RNA, 1410 nt, Artificial Sequence; identical to SEQ ID NO: 49914
  neuraminidase__InfluenzaA__ADN89911

SEQ ID NO: 50506 - RNA, 1410 nt, Artificial Sequence
  neuraminidase__InfluenzaA__ADN89922
augaauccaaaucaaaagauaauaacgauuggcucuguuucucucaccauuuccacaauaugcuucuucaugcaaauugccaucuugauaacuacuguaacauugcauuucaagcaauauaaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaaugugacauuacgggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucgaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaauuguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaauaucaugccuauauaa

SEQ ID NO: 50507 - RNA, 1410 nt, Artificial Sequence; identical to SEQ ID NO: 49914
  neuraminidase__InfluenzaA__ADN89933

SEQ ID NO: 50508 - RNA, 1410 nt, Artificial Sequence; identical to SEQ ID NO: 49914
  neuraminidase__InfluenzaA__ADN89955

SEQ ID NO: 50509 - RNA, 1410 nt, Artificial Sequence; identical to SEQ ID NO: 49914
  neuraminidase__InfluenzaA__ADN89966

SEQ ID NO: 50510 - RNA, 1410 nt, Artificial Sequence; identical to SEQ ID NO: 49914
  neuraminidase__InfluenzaA__ADN89977

SEQ ID NO: 50511 - RNA, 1410 nt, Artificial Sequence; identical to SEQ ID NO: 49914
  neuraminidase__InfluenzaA__ADN89988

SEQ ID NO: 50512 - RNA, 1410 nt, Artificial Sequence; identical to SEQ ID NO: 49914
  neuraminidase__InfluenzaA__ADN89999

SEQ ID NO: 50513 - RNA, 1410 nt, Artificial Sequence; identical to SEQ ID NO: 49914
  neuraminidase__InfluenzaA__ADN90010

SEQ ID NO: 50514 - RNA, 1410 nt, Artificial Sequence
  neuraminidase__InfluenzaA__ADN90021
augaauccaaaucaaaagauaauaacgauuggcucuguuucucucaccauuuccacaauaugcuucuucaugcaaauugccaucuugauaacuacuguaacauugcauuucaagcaauauaaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaaugugacauuacgggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucgaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaauuguucauacuagcaccuugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 50515 - RNA, 1410 nt, Artificial Sequence; identical to SEQ ID NO: 49914
  neuraminidase__InfluenzaA__ADN90032

SEQ ID NO: 50516 - RNA, 1410 nt, Artificial Sequence; identical to SEQ ID NO: 49914
  neuraminidase__InfluenzaA__ADN90043

SEQ ID NO: 50517 - RNA, 1410 nt, Artificial Sequence; identical to SEQ ID NO: 49914
  neuraminidase__InfluenzaA__ADN90054

SEQ ID NO: 50518 - RNA, 1410 nt, Artificial Sequence; identical to SEQ ID NO: 49914
  neuraminidase__InfluenzaA__ADN90065

SEQ ID NO: 50519 - RNA, 1410 nt, Artificial Sequence; identical to SEQ ID NO: 49914
  neuraminidase__InfluenzaA__ADN90076

SEQ ID NO: 50520 - RNA, 1410 nt, Artificial Sequence; identical to SEQ ID NO: 49914
  neuraminidase__InfluenzaA__ADN90087

SEQ ID NO: 50521 - RNA, 1410 nt, Artificial Sequence; identical to SEQ ID NO: 49914
  neuraminidase__InfluenzaA__ADN90098

SEQ ID NO: 50522 - RNA, 1410 nt, Artificial Sequence; identical to SEQ ID NO: 49914
  neuraminidase__InfluenzaA__ADN90109

SEQ ID NO: 50523 - RNA, 1410 nt, Artificial Sequence; identical to SEQ ID NO: 49914
  neuraminidase__InfluenzaA__ADN90120

SEQ ID NO: 50524 - RNA, 1410 nt, Artificial Sequence; identical to SEQ ID NO: 49914
  neuraminidase__InfluenzaA__ADN90131

SEQ ID NO: 50525 - RNA, 1410 nt, Artificial Sequence; identical to SEQ ID NO: 49914
  neuraminidase__InfluenzaA__ADN90142

SEQ ID NO: 50526 - RNA, 1410 nt, Artificial Sequence; identical to SEQ ID NO: 49914
  neuraminidase__InfluenzaA__ADN90153

SEQ ID NO: 50527 - RNA, 1410 nt, Artificial Sequence; identical to SEQ ID NO: 49914
  neuraminidase__InfluenzaA__ADN90164

SEQ ID NO: 50528 - RNA, 1410 nt, Artificial Sequence; identical to SEQ ID NO: 49914
  neuraminidase__InfluenzaA__ADN90186

SEQ ID NO: 50529 - RNA, 1410 nt, Artificial Sequence; identical to SEQ ID NO: 49914
  neuraminidase__InfluenzaA__ADN90197

SEQ ID NO: 50530 - RNA, 1410 nt, Artificial Sequence
  neuraminidase__InfluenzaA__ADN90208
augaauccaaaucaaaagauaauaacgauuggcucuguuucucucaccauuuccacaauaugcuucuucaugcaaauugccaucuugauaacuacuguaacauugcauuucaagcaauauaaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaaugugacauuacgggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucgaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaauuguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaaguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 50531 - RNA, 1410 nt, Artificial Sequence; identical to SEQ ID NO: 49914
  neuraminidase__InfluenzaA__ADN90219

SEQ ID NO: 50532 - RNA, 1410 nt, Artificial Sequence
  neuraminidase__InfluenzaA__ADN92469
augaauccaaaucaaaagauaauaacgauuggcucuguuucucucaccauuuccacaauaugcuucuucaugcaaauugccaucuuaauaacuacuguaacauugcauuucaagcaauaugaauucaacucccccccaaacaaccaagugaugcugugugaaccaacaauaauagaaagaaacauaacagagauaguguaucugaccaacaccaccauagagaaagaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucagaaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaauaaugaggaagguggucauggggugaaaggcugggccuuugaugauggaaaugacguguggaugggaagaacgaucagcgagaagucacgcuuaggguaugaaaccuucaaagucauugaaggaugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50533 - RNA, 1410 nt, Artificial Sequence
  neuraminidase__InfluenzaA__ADN92480
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacacgagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggaugguccaauccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaaugaagucuuguggaccucaaacaguauuguuguguuuuguggcaccucagguacauauggaacaggcucauggccugauggggcggacaucaaucucaugccuauauaa

SEQ ID NO: 50534 - RNA, 1410 nt, Artificial Sequence; identical to SEQ ID NO: 50533
  neuraminidase__InfluenzaA__ADN92491

SEQ ID NO: 50535 - RNA, 1410 nt, Artificial Sequence
  neuraminidase__InfluenzaA__ADN92502
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacacgagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccaguucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaaggugguaauggggugaaaggcugggccuuugaugauggaaaugauguguggaugggaagaacgaucagcgagaagucacgcuuaggguaugaaaccuucaaagucauugaaggaugguccaauccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaaugaagucuuguggaccucaaacaguauuguuguguuuuguggcaccucagguacauauggaacaggcucauggccugauggggcggacaucaaucucaugccuauauaa

SEQ ID NO: 50536 - RNA, 1410 nt, Artificial Sequence; identical to SEQ ID NO: 47242
  neuraminidase__InfluenzaA__ADN92512

SEQ ID NO: 50537 - RNA, 1410 nt, Artificial Sequence
  neuraminidase__InfluenzaA__ADN92522
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaauuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50538 - RNA, 1410 nt, Artificial Sequence; identical to SEQ ID NO: 47242
  neuraminidase__InfluenzaA__ADN92532

SEQ ID NO: 50539 - RNA, 1410 nt, Artificial Sequence; identical to SEQ ID NO: 47242
  neuraminidase__InfluenzaA__ADN92542

SEQ ID NO: 50540 - RNA, 1410 nt, Artificial Sequence; identical to SEQ ID NO: 50537
  neuraminidase__InfluenzaA__ADN92552

SEQ ID NO: 50541 - RNA, 1410 nt, Artificial Sequence
  neuraminidase__InfluenzaA__ADO00733
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaaaaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50542 - RNA, 1410 nt, Artificial Sequence
  neuraminidase__InfluenzaA__ADO00743
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacguggguaaaucagacauauguuaacaucagcaacaccaacuuugcugcuggacagucagugguuuccgcgaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaggcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 50543 - RNA, 1410 nt, Artificial Sequence; identical to SEQ ID NO: 48419
  neuraminidase__InfluenzaA__ADO00753

SEQ ID NO: 50544 - RNA, 1410 nt, Artificial Sequence; identical to SEQ ID NO: 47242
  neuraminidase__InfluenzaA__ADO12146

SEQ ID NO: 50545 - RNA, 1410 nt, Artificial Sequence; identical to SEQ ID NO: 47242
  neuraminidase__InfluenzaA__ADO12156

SEQ ID NO: 50546 - RNA, 1410 nt, Artificial Sequence; identical to SEQ ID NO: 47242
  neuraminidase__InfluenzaA__ADO12166

SEQ ID NO: 50547 - RNA, 1410 nt, Artificial Sequence; identical to SEQ ID NO: 47242
  neuraminidase__InfluenzaA__ADO12176

SEQ ID NO: 50548 - RNA, 1410 nt, Artificial Sequence; identical to SEQ ID NO: 47242
  neuraminidase__InfluenzaA__ADO12186

SEQ ID NO: 50549 - RNA, 1410 nt, Artificial Sequence; identical to SEQ ID NO: 47242
  neuraminidase__InfluenzaA__ADO12196

SEQ ID NO: 50550 - RNA, 1410 nt, Artificial Sequence; identical to SEQ ID NO: 47242
  neuraminidase__InfluenzaA__ADO12206

SEQ ID NO: 50551 - RNA, 1410 nt, Artificial Sequence; identical to SEQ ID NO: 47242
  neuraminidase__InfluenzaA__ADO12216

SEQ ID NO: 50552 - RNA, 1410 nt, Artificial Sequence; identical to SEQ ID NO: 47242
  neuraminidase__InfluenzaA__ADO12226

SEQ ID NO: 50553 - RNA, 1410 nt, Artificial Sequence
  neuraminidase__InfluenzaA__ADO12246
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaacaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50554 - RNA, 1410 nt, Artificial Sequence; identical to SEQ ID NO: 47242
  neuraminidase__InfluenzaA__ADO12266

SEQ ID NO: 50555 - RNA, 1410 nt, Artificial Sequence
  neuraminidase__InfluenzaA__ADO12276
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagucaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50556 - RNA, 1410 nt, Artificial Sequence; identical to SEQ ID NO: 47242
  neuraminidase__InfluenzaA__ADO12286

SEQ ID NO: 50557 - RNA, 1410 nt, Artificial Sequence; identical to SEQ ID NO: 47242
  neuraminidase__InfluenzaA__ADO12296

SEQ ID NO: 50558 - RNA, 1410 nt, Artificial Sequence; identical to SEQ ID NO: 47242
  neuraminidase__InfluenzaA__ADO12306

SEQ ID NO: 50559 - RNA, 1410 nt, Artificial Sequence
  neuraminidase__InfluenzaA__ADO12316
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacucuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcgaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50560 - RNA, 1410 nt, Artificial Sequence; identical to SEQ ID NO: 50553
  neuraminidase__InfluenzaA__ADO12326

SEQ ID NO: 50561 - RNA, 1410 nt, Artificial Sequence; identical to SEQ ID NO: 47242
  neuraminidase__InfluenzaA__ADO12336

SEQ ID NO: 50562 - RNA, 1410 nt, Artificial Sequence; identical to SEQ ID NO: 47242
  neuraminidase__InfluenzaA__ADO12346

SEQ ID NO: 50563 - RNA, 1410 nt, Artificial Sequence; identical to SEQ ID NO: 47242
  neuraminidase__InfluenzaA__ADO12356

SEQ ID NO: 50564 - RNA, 1410 nt, Artificial Sequence; identical to SEQ ID NO: 47242
  neuraminidase__InfluenzaA__ADO12366

SEQ ID NO: 50565 - RNA, 1410 nt, Artificial Sequence; identical to SEQ ID NO: 50553
  neuraminidase__InfluenzaA__ADO12376

SEQ ID NO: 50566 - RNA, 1410 nt, Artificial Sequence; identical to SEQ ID NO: 47242
  neuraminidase__InfluenzaA__ADO12386

SEQ ID NO: 50567 - RNA, 1410 nt, Artificial Sequence; identical to SEQ ID NO: 47242
  neuraminidase__InfluenzaA__ADO12396

SEQ ID NO: 50568 - RNA, 1410 nt, Artificial Sequence; identical to SEQ ID NO: 47242
  neuraminidase__InfluenzaA__ADO12406

SEQ ID NO: 50569 - RNA, 1410 nt, Artificial Sequence
  neuraminidase__InfluenzaA__ADO12416
augaauccaaaccaaaagauaauaaccauugguucggucuguauuacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacgggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggaccagcgggagcagcauauccuuuugugguguaaacagugacacuguggguuggucuuggccagacggugcugaguugccauuuaccauugacaaguaa

SEQ ID NO: 50570 - RNA, 1410 nt, Artificial Sequence; identical to SEQ ID NO: 47242
  neuraminidase__InfluenzaA__ADO12426

SEQ ID NO: 50571 - RNA, 1410 nt, Artificial Sequence; identical to SEQ ID NO: 47242
  neuraminidase__InfluenzaA__ADO12436

SEQ ID NO: 50572 - RNA, 1410 nt, Artificial Sequence; identical to SEQ ID NO: 47242
  neuraminidase__InfluenzaA__ADO12446

SEQ ID NO: 50573 - RNA, 1410 nt, Artificial Sequence; identical to SEQ ID NO: 47242
  neuraminidase__InfluenzaA__ADO12456

SEQ ID NO: 50574 - RNA, 1410 nt, Artificial Sequence; identical to SEQ ID NO: 47242
  neuraminidase__InfluenzaA__ADO12466

SEQ ID NO: 50575 - RNA, 1410 nt, Artificial Sequence
  neuraminidase__InfluenzaA__ADO12476
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaauaacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50576 - RNA, 1410 nt, Artificial Sequence; identical to SEQ ID NO: 48435
  neuraminidase__InfluenzaA__ADO12486

SEQ ID NO: 50577 - RNA, 1410 nt, Artificial Sequence; identical to SEQ ID NO: 47242
  neuraminidase__InfluenzaA__ADO12496

SEQ ID NO: 50578 - RNA, 1410 nt, Artificial Sequence
  neuraminidase__InfluenzaA__ADO12506
augaauccaaaccaaaagauaauaaccauugguucggucuguaugacaauuggaauggcuaacuugauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50579 - RNA, 1410 nt, Artificial Sequence
  neuraminidase__InfluenzaA__ADO12516
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaauaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50580 - RNA, 1410 nt, Artificial Sequence; identical to SEQ ID NO: 47242
  neuraminidase__InfluenzaA__ADO12526

SEQ ID NO: 50581 - RNA, 1410 nt, Artificial Sequence; identical to SEQ ID NO: 48435
  neuraminidase__InfluenzaA__ADO12536

SEQ ID NO: 50582 - RNA, 1410 nt, Artificial Sequence; identical to SEQ ID NO: 47242
  neuraminidase__InfluenzaA__ADO12546

SEQ ID NO: 50583 - RNA, 1410 nt, Artificial Sequence; identical to SEQ ID NO: 47242
  neuraminidase__InfluenzaA__ADO12556

SEQ ID NO: 50584 - RNA, 1410 nt, Artificial Sequence; identical to SEQ ID NO: 47242
  neuraminidase__InfluenzaA__ADO12566

SEQ ID NO: 50585 - RNA, 1410 nt, Artificial Sequence
  neuraminidase__InfluenzaA__ADO12576
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucacccuuggaaugcagaaccuucuucuugacucaaggggccuugcuaaaugauaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50586 - RNA, 1410 nt, Artificial Sequence
  neuraminidase__InfluenzaA__ADO12586
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaguggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50587 - RNA, 1410 nt, Artificial Sequence; identical to SEQ ID NO: 50586
  neuraminidase__InfluenzaA__ADO12596

SEQ ID NO: 50588 - RNA, 1410 nt, Artificial Sequence
  neuraminidase__InfluenzaA__ADO12606
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggccauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50589 - RNA, 1410 nt, Artificial Sequence; identical to SEQ ID NO: 48728
  neuraminidase__InfluenzaA__ADO12616

SEQ ID NO: 50590 - RNA, 1410 nt, Artificial Sequence; identical to SEQ ID NO: 47242
  neuraminidase__InfluenzaA__ADO12626

SEQ ID NO: 50591 - RNA, 1410 nt, Artificial Sequence; identical to SEQ ID NO: 47306
  neuraminidase__InfluenzaA__ADO14355

SEQ ID NO: 50592 - RNA, 1401 nt, Artificial Sequence
  neuraminidase__InfluenzaA__ADO21028
augaauccaaaucagaagauaauagcaauuggcucuguuucucuaacuauugcgacaauauguuuccucaugcagauugccauacuagcaacgacuaugacacuacauuucaagcagaaugaaugcagcaaccccucgaauaaucaaguagugccaugugaaccaaccauaauagaaaggaacauagugcauuugaauaguacuaccauagagaaggaaauuuguccuaaaguggcagaauacaagaauuggucaaaaccacaaugucaaauuacaggguccgcuccuuucuccaagggcaacucaauuaggcuuuccgcagguggggauaucugggugacaagagaaccuuauguaucgugcagucucgguaaauguuaucaauuugcacuugggcagggaaccacuuugaaaaacaaacacucaaauggaacuacacaugacagaguuccucauagaacccuuuuaaugagugaguugggugucccguuucauuugggaaccaaacaagugugcauagcaugguccagcucaagcugccaugaugggaaagcaugguuacauguuugugucacuggggaugauaaaaaugcgacugcuaguaucauuuaugaugggaugcuuguugacagcauugguucaugguccaaaaacauccucagaacccaggagucagaaugcguuugcaucaaugggacuuguacaguagugaugacugauggaagugcaucgggaaaggcugacacuagaauacuauucauaagagaggggaaaauuguacacauuagcccauugucaggaagugcucagcauguggaggaaugcuccuguuacccccgguauccagaaguuagguguguuugcagagacaauuggaagggcuccaauaggcccguucuauacauaaauauggcagauuauaguauugaguccaguuaugugugcucaggacuuguuggcgacacaccaagaaaugaugauagcuacagcagcagcaacugcagggauccaaauaacgagagaggggccccaggagugaaagggugggccuuugacaauggaaaugauauuuggaugggacgaacaaucaaagaggauucacgcucagguuaugagacuuucagggucguuggugguuggaccacagcuaauuccaagucacagauaaauagacaagucauaguugacagugacaacuggucuggguauucugguaucuucucuguugaaggcaaaaacugcaucaacagguguuuuuauguugaguugauaagaggaagaccacaggagacuagggugugguggacuucaaauagcauaauuguauuuuguggaaccucagguaccuauggaacaggcucauggccugauggggcgaauaucaacuucaugccuauauaa

SEQ ID NO: 50593 - RNA, 1401 nt, Artificial Sequence
  neuraminidase__InfluenzaA__ADO21039
augaauccaaaucagaagauaauagcaauuggcucuguuucucuaacuauugcgacaauauguuuccucaugcagauugccauacuagcaacgacuaugacacuacauuucaagcagaaugaaugcagcaaccccucgaauaaucaaguagugccaugugaaccaaccauaauagaaaggaacauagugcauuugaauaguacuaccauagagaaggaaauuuguccuaaaguggcagaauacaagaauuggucaaaaccacaaugucaaauuacaggguccgcuccuuucuccaagggcaacucaauuaggcuuuccgcagguggggauaucugggugacaagagaaccuuauguaucgugcagucucgguaaauguuaucaauuugcacuugggcagggaaccacuuugaaaaacaaacacucaaauggaacuacacaugauagagauccucauagaacccuuuuaaugagugaguugggugucccguuucauuugggaaccaaacaagugugcauagcaugguccagcucaagcugccaugaugggaaagcaugguuacauguuugugucacuggggaugauaaaaaugcgacugcuaguaucauuuaugaugggaugcuuguugacagcauugguucaugguccaaaaacauccucagaacccaggagucagaaugcguuugcaucaaugggacuuguacaguagugaugacugauggaagugcaucgggaaaggcugacacuagaauacuauucauaagagaggggaaaauuguacacauuagcccauugucaggaagugcucagcauguggaggaaugcuccuguuacccccgguauccagaaguuagguguguuugcagagacaauuggaagggcuccaauaggcccguucuauacauaaauauggcagauuauacuauugaguccaguuaugugugcucaggacuuguuggcgacacaccaagaaaugaugauagcuacagcagcagcaacugcagggauccaaauaacgagagaggggccccaggagugaaagggugggccuuugacaauggaaaugauauuuggaugggacgaacaaucaaagaggauucacgcucagguuaugagacuuucagggucguuggugguuggaccacagcuaauuccaagucacagauaaauagacaagucauaguugacagugacaacuggucuggguauucugguaucuucucuguugaaggcaaaaacugcaucaacagguguuuuuauguugaguugauaagaggaagaccacaggagacuagggugugguggacuucaaauagcauaauuguauuuuguggaaccucagguaccuauggaacaggcucauggccugauggggcgaauaucaacuucaugccuauauaa

SEQ ID NO: 50594 - RNA, 1401 nt, Artificial Sequence
  neuraminidase__InfluenzaA__ADO21050
augaauccaaaucagaagauaauagcaauuggcucuguuucucuaacuauugcgacaauauguuuccucaugcagauugccauacuagcaacgacuaugacacuacauuucaagcagaaugaaugcagcaaccccucgaauaaucaaguagugccaugugaaccaaccauaauagaaaggaacauagugcauuugaauaguacuaccauagagaaggaaauuuguccuaaaguggcagaauacaagaauuggucaaaaccacaaugucaaauuacaggguccgcuccuuucuccaagggcaacucaauuaggcuuuccgcagguggggauaucugggugacaagagaaccuuauguaucgugcagucucgguaaauguuaucaauuugcacuugggcagggaaccacuuugaaaaacaaacacucaaauggaacuacacaugauagagguccucauagaacccuuuuaaugagugaguugggugucccguuucauuugggaaccaaacaagugugcauagcaugguccagcucaagcugccaugaugggaaagcaugguuacauguuugugucacuggggaugauaaaaaugcgacugcuaguaucauuuaugaugggaugcuuguugacagcauugguucaugguccaaaaacauccucagaacccaggagucagaaugcguuugcaucaaugggacuuguacaguagugaugacugauggaagugcaucgggaaaggcugacacuagaauacuauucauaagagaggggaaaauuguacacauuagcccauugucaggaagugcucagcauguggaggaaugcuccuguuacccccgguauccagaaguuagguguguuugcagagacaauuggaagggcuccaauaggcccguucuauacauaaauauggcagauuauaguauugaguccaguuaugugugcucaggacuuguuggcgacacaccaagaaaugaugauagcuacagcagcagcaacugcagggauccaaauaacgagaguggggccccaggagugaaagggugggccuuugacaauggaaaugauauuuggaugggacgaacaaucaaagaggauucacgcucagguuaugagacuuucagggucguuggugguuggaccacagcuaauuccaagucacagauaaauagacaagucauaguugacagugacaacuggucuggguauucugguaucuucucuguugaaggcaaaaacugcaucaacagguguuuuuauguugaguugauaagaggaagaccacaggagacuagggugugguggacuucaaauagcauaauuguauuuuguggaaccucagguaccuauggaacaggcucauggccugauggggcgaauaucaacuucaugccuauauaa

SEQ ID NO: 50595 - RNA, 1410 nt, Artificial Sequence
  neuraminidase__InfluenzaA__ADO25095
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcaucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaaugggguaaaaggauuuucauucaaauacggcaaugguguuuggauagggagaacuaaaagcauuaguucaagaagcgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50596 - RNA, 1410 nt, Artificial Sequence
  neuraminidase__InfluenzaA__ADO25105
augaauccaaaccaaaagauaauaaccauugguucggucuguaugacaauuggaauggcuaacuuaauauuacaaauuggaaacauaaucucaauauggauuagccacucaauucaacuugggaaucaaaaucagauuggaacaugcaaucaaagcgucauuacuuaugaaaccaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccuagugauagacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50597 - RNA, 1410 nt, Artificial Sequence; identical to SEQ ID NO: 49126
  neuraminidase__InfluenzaA__ADO25115

SEQ ID NO: 50598 - RNA, 1410 nt, Artificial Sequence; identical to SEQ ID NO: 49126
  neuraminidase__InfluenzaA__ADO25125

SEQ ID NO: 50599 - RNA, 1410 nt, Artificial Sequence
  neuraminidase__InfluenzaA__ADO25135
augaauccaaaccaaaagauaauaaccauugguucggucuguaugacaauuggaauggcuaacuuaguauuacaaauuggaaacauaaucucaauauggauuagccacucaauucaacuugggaaucaaaaucagauugaaacauguaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50600 - RNA, 1410 nt, Artificial Sequence; identical to SEQ ID NO: 48668
  neuraminidase__InfluenzaA__ADO25145

SEQ ID NO: 50601 - RNA, 1410 nt, Artificial Sequence; identical to SEQ ID NO: 47242
  neuraminidase__InfluenzaA__ADO25155

SEQ ID NO: 50602 - RNA, 1410 nt, Artificial Sequence; identical to SEQ ID NO: 47242
  neuraminidase__InfluenzaA__ADO25165

SEQ ID NO: 50603 - RNA, 1410 nt, Artificial Sequence; identical to SEQ ID NO: 47242
  neuraminidase__InfluenzaA__ADO25175

SEQ ID NO: 50604 - RNA, 1410 nt, Artificial Sequence
  neuraminidase__InfluenzaA__ADO25185
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgagaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcaugaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50605 - RNA, 1410 nt, Artificial Sequence
  neuraminidase__InfluenzaA__ADO25195
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaaugaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 50606 - RNA, 1410 nt, Artificial Sequence; identical to SEQ ID NO: 48379
  neuraminidase__InfluenzaA__ADO25205

SEQ ID NO: 50607 - RNA, 1410 nt, Artificial Sequence; identical to SEQ ID NO: 48668
  neuraminidase__InfluenzaA__ADO25215

SEQ ID NO: 50608 - RNA, 1410 nt, Artificial Sequence
  neuraminidase__InfluenzaA__ADO25225
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucaaauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50609 - RNA, 1410 nt, Artificial Sequence
  neuraminidase__InfluenzaA__ADO25235
augaauccaaaccaaaagauaauaaucauugguucggucuguaugacaauuggaauggcuaacuuaauauuacaaauuggaaacauaaucucaauauggauuagccacucaauucaacuugggaaucaaaaucagauugaaacaugcaaccaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50610 - RNA, 1410 nt, Artificial Sequence; identical to SEQ ID NO: 47242
  neuraminidase__InfluenzaA__ADO25245

SEQ ID NO: 50611 - RNA, 1410 nt, Artificial Sequence
  neuraminidase__InfluenzaA__ADO25255
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauaucuuuuugugguguaaacagugacacuguggguuggucuuggccagacggugcugaguugccauuuaccauugacaaguaa

SEQ ID NO: 50612 - RNA, 1410 nt, Artificial Sequence; identical to SEQ ID NO: 49126
  neuraminidase__InfluenzaA__ADO25265

SEQ ID NO: 50613 - RNA, 1410 nt, Artificial Sequence
  neuraminidase__InfluenzaA__ADO25275
augaauccaaaccaaaagauaauaaccauugguucggucuguaugacaauuggaauggcuaacuuaauauuacaaauugggaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcucauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguauaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50614 - RNA, 1410 nt, Artificial Sequence; identical to SEQ ID NO: 48668
  neuraminidase__InfluenzaA__ADO25285

SEQ ID NO: 50615 - RNA, 1413 nt, Artificial Sequence
  neuraminidase__InfluenzaA__ADO27623
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauauguaaccaaagaaucaucacauaugaaaacagcaccugggugaaucacacauauguuaauauuaacaacacuaauguugcugcuggagaagacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguucggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50616 - RNA, 1410 nt, Artificial Sequence; identical to SEQ ID NO: 47242
  neuraminidase__InfluenzaA__ADO30410

SEQ ID NO: 50617 - RNA, 1410 nt, Artificial Sequence; identical to SEQ ID NO: 48668
  neuraminidase__InfluenzaA__ADO30420

SEQ ID NO: 50618 - RNA, 1410 nt, Artificial Sequence; identical to SEQ ID NO: 48139
  neuraminidase__InfluenzaA__ADP95343

SEQ ID NO: 50619 - RNA, 1410 nt, Artificial Sequence
  neuraminidase__InfluenzaA__ADP95353
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacagcaaagacaacaguguaagaaucgguuccaagggggauguguuugucauaagagaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50620 - RNA, 1410 nt, Artificial Sequence; identical to SEQ ID NO: 50619
  neuraminidase__InfluenzaA__ADP95363

SEQ ID NO: 50621 - RNA, 1410 nt, Artificial Sequence; identical to SEQ ID NO: 50619
  neuraminidase__InfluenzaA__ADP95373

SEQ ID NO: 50622 - RNA, 1410 nt, Artificial Sequence; identical to SEQ ID NO: 50619
  neuraminidase__InfluenzaA__ADP95383

SEQ ID NO: 50623 - RNA, 1410 nt, Artificial Sequence; identical to SEQ ID NO: 50619
  neuraminidase__InfluenzaA__ADP95393

SEQ ID NO: 50624 - RNA, 1410 nt, Artificial Sequence
  neuraminidase__InfluenzaA__ADQ43774
augaauccaaaccaaaagauaauaaccauugguucgggcuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaagccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuuuggagacaauccacgcccuaaugauaagacaggcaguuguggucccguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaauaa

SEQ ID NO: 50625 - RNA, 1410 nt, Artificial Sequence
  neuraminidase__InfluenzaA__ADQ92578
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugauacugugugaaccaacaauaauagaaagaaacauaacagagauaguguaucugaccaacgccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauaccagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuaugugugcucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaaguuuuguggaccucaaacaguauuguuguguuuuguggcaccucagguacauauggaacaggcucauggccugauggggcggacaucaaucucaugccuauauaa

SEQ ID NO: 50626 - RNA, 1410 nt, Artificial Sequence; identical to SEQ ID NO: 49755
  neuraminidase__InfluenzaA__ADR32364

SEQ ID NO: 50627 - RNA, 1410 nt, Artificial Sequence
  neuraminidase__InfluenzaA__ADT64478
augaauccaaaccaaaagauaauaaccauugguucggucuguaugacaauuggaauggcuaacuuaauauuacaaauuggaaacauaaucucaauauggauaggccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50628 - RNA, 1410 nt, Artificial Sequence
  neuraminidase__InfluenzaA__ADT78889
augaauccaaaucaaaagauaauaacaauuggcucugucucucucaccauugcaacaguaugcuuccucaugcagauugccauccugguaacuacuguaacauugcauuuuaagcaacaugagugcgacucccccgcgagcaaccaaguaaugccaugugaaccaauaauaauagaaaggaacauaacagagauaguguauuugaauaacaccaccauagagaaagagaucugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguguagcaugguccagcucaaguugucacgauggaaaagcaugguugcauguuugugucacuggggaugauaaaaaugcaacugcuagcuucauuuaugacgggaggcuuguggacaguauugguucauggucucaaaauauccucaggacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaggaguguuccuguuauccucgauauccugacgucagauguaucugcagagauaacuggaaaggcucuaauaggcccgucauagacauaaauauggaagauuauagcauugauuccaguuaugugugcucagggcuuguuggcgacacacccagaaacgacgauagaucuagcaauagcaauugcagggauccuaacaaugagagagggaauccaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaggucauaguugacagcaauaauuggucagguuacucugguauuuucucuguugagggcaaaagcugcaucaauaggugcuuuuauguggaguugauaaggggaaggcaacaggagacuagaguaugguggaccucaaacaguauuguuguguuuuguggcacuucagguacuuauggaacaggcucauggccugauggggcgaacaucaguuucaugccuauauaa

SEQ ID NO: 50629 - RNA, 1410 nt, Artificial Sequence
  neuraminidase__InfluenzaA__ADT78899
augaauccaaaucaaaagauaauaacaauuggcucugucucucucaccauugcaacaguaugcuuccucaugcagauugccauccuggcaacuacugugacauugcauuuuaagcaacaugagugcgacucccccgcgagcaaccaaguaaugccaugugaaccaauaauaauagaaaggaacauaacagagauaguguauuugaauaacaccaccauagagaaagagauuugccccgaaguaguggaauacagaaauuggucaaagccgcaaugucaaauuacaggauuugcaccuuuuucuaaggacaauucaauccggcuuucugcugguggggacauuugggugaugagagaaccuuaugugucaugcaauccuggcaaguguuaucaauuugcacucgggcaggggaccacacuagacaacaaacauucaaauggcacaauacaugauagaaucccucaucgaacccuauuaaugaaugaguuggguguuccauuucauuuaggaaccaaacaaguguguguagcaugguccagcucaaguugucacgauggaaaagcaugguugcauguuugugucacuggggaugauagaaaugcaacugcuagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaguguuccuguuacccucgauauccugacgucagauguaucugcagagacaacuggaaaggcucuaauaggcccguuauagacauaaauauggaagauuauagcauugauuccaguuaugugugcucaggacuuguuggcgacacacccagaaacgacgacagcucuagcaauagcaauugcagggauccuaacaaugagagagggaauccaggagugaaaggcugggccuuugacaauggagaugauguauggaugggaagaacaaucagcaaagauuuacgcucagguuaugaaacuuucaaagucauuggugguugguccacaccuaauuccaaaucgcaggucaauagacaggucauaguugacaacaauaauuggucugguuacucugguauuuucucuguugagggcaaaagcugcaucaauaggugcuuuuauguggaguugauaaggggaaggccacaggagacuagaguaugguggaccucaagcaguauuguuguguuuuguggcacuucagguacuuauggaacaggcucauggccugauggggcgaacaucaauuucaugccuauauaa

SEQ ID NO: 50630 - RNA, 1410 nt, Artificial Sequence
  neuraminidase__InfluenzaA__ADT78963
augaauccaaaucaaaagauaauaacaauuggcucugucucucucaccauugcaacaguaugcuuccucaugcagauugccauccuggcaacuacugugacauugcauuuuaagcaacaugagugcgacucccccgcgagcaaccaaguaaugccaugugaaccaauaauaauagaaaggaacauaacagagauaguguauuugaauaacaccaccauagagaaagagaucugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauuaaugaaugaguuggguguuccauuucauuuaggaaccagacaaguguguguagcaugguccagcucaaguugucacgauggaaaagcaugguugcauguuugugucacuggggaugauagaaaugcaacugcuagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauguagaggaguguuccuguuauccucgauauccugacgucagauguaucugcagagacaacuggaaaggcucuaauaggcccguuauagacauaaauauggaagauuauagcauugauuccaguuaugugugcucagggcuuguuggcgacacacccagaaacgacgacagaucuagcaauagcaauugcagggauccuaacaaugagagagggaauccaggagugaaaggcugggccuuugacaauggaaaugacguguggaugggaagaacgaucagcaaagauuuacgcucagguuaugaaacuuucaaagucauuggugguugguccacaccuaauuccaaaucgcaggucaauagacaggucauaguugacaacaauaauuggucugguuacucugguauuuucucuguugagggcaaaagcugcaucaauaggugcuuuuauguggaguugauaaggggaaggcaacaggagacuagaguaugguggaccucaaacaguauuguuguguuuuguggcacuucagguacuuauggaacaggcucauggccugauggggcgaacaucaauuucaugccuauauaa

SEQ ID NO: 50631 - RNA, 1410 nt, Artificial Sequence
  neuraminidase__InfluenzaA__ADT79001
augaauccaaaucaaaagauaauaacaauuggcucuaucucucucaccauugcaacaauaugcuuccucaugcagauugccauccugguaacuacuguaacauugcauuucaagcaauaugagugcgacucccccgcgaacaaccaaguaaugccgugugaaccaauaauaauagaaaggaacauaacagaaauaguguauuugacuaacaccaccauagagaaagagauaugccccaaauuaguggaauacaggaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauugaugaaugaguuggguguuccauuucauuugggaaccaggcaaguguguauagcaugguccagcucaaguugucacgauggaaaagcauggcugcauguuugugucacuggggaugauaaaaaugcaacugcuagcuucauuuacgaugggaggcuuguggacaguauugguucauggucucaaaauauccucaggacccaggagucggaaugcguuuguaucaaugggacuuguacaguaguaaugacugauggaagugcuucaggaaaagcugauacuagaauacuauucauugaagaggggaaaauuguucauauuagcccauugucaggaagugcucagcauguagaggaguguuccuguuauccucgauauccuggugucagauguaucugcagagacaacuggaaaggcucuaauaggcccgucguagauauaaaugugaaagauuauagcauugauuccaguuaugugugcucagggcuuguuggcgacacacccagaaacaacgacagaucuagcaguagcuauugccggaauccuaacaaugagagagggaaucacggagugaaaggcugggccuuugacgauggaaaugacguguggaugggaagaacgaucagcaaggauucacgcucagguuaugaaaccuucaaagucauuggugguugguccacaccuaauuccaaaucgcagauaaauaggcaagucauaguugacagcgauaauaggucagguuauucugguauuuucucuguugagggcaaaagcugcaucaauaggugcuuuuauguggaguugauaaggggaagggaacaggagacuagaguaugguggaccucaaacaguauuguuguguuuuguggcacuucagguaccuaugggacaggcucauggccugauggggcggacaucaaucucaugccuauauaa

SEQ ID NO: 50632 - RNA, 1410 nt, Artificial Sequence
  neuraminidase__InfluenzaA__ADT79021
augaauccaaaucaaaagauaauaacaauuggcucugucucucucaccauugcgacaauaugcuuccucaugcagauugccauccugguaacuacuguaacauugcauuucaagcaauaugagugcgacucccccgcgaacaaccaaguaaugccgugugaaccaauaauaauagaaaggaacauaacagagauaguguauuugacuaacaccaccauagagaaagagauaugccccaaauuaguggaauacaggaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaccccucaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucauggucucaaaauauccucaggacccaggagucggaaugcguuuguaucaaugggacuuguacaguaguaaugacugauggaagugcuucaggaagagcugauacuaaaauacuauucauugaagaggggaaaauuguucauauuagcccauugucaggaagugcucagcauguagaggaguguuccuguuauccucgauauccuggugucagauguaucugcagagacaacuggaaaggcucuaauaggcccgucguagauauaaaugugaaagauuauagcauugauuccaguuaugugugcucagggcuuguuggcgacacacccagaaacaacgacagaucuagcaauagcuauugccggaauccuaacaaugagaaagggaaucacggagugaaaggcugggccuuugacgauggaaaugacguguggaugggaagaacgaucagcgaggauucacgcucagguuaugaaaccuucaaagucauuggugguugguccacaccuaauuccaaauugcagauaaauaggcaagucauaguugacagcgauaauaggucagguuauucugguauuuucucuguugagggcaaaagcugcaucaauaggugcuuuuauguggaguugauaaggggaagggaacaggaaacuagaguaugguggaccucaaacaguauuguuguguuuuguggcacuucagguaccuaugggacaggcucauggccugauggggcggacaucaaucucaugccuauauaa

SEQ ID NO: 50633 - RNA, 1410 nt, Artificial Sequence
  neuraminidase__InfluenzaA__ADT79041
augaauccaaaucaaaagauaauaacaauuggcucugucucucucaccauugcaacaguaugcuuccucaugcagauugccauccugguaacuacuguaacauugcauuucaggcaauaugagugcgacucucccgcgaacaaccaaguaaugccgugugaaccaauaauaauagaaaggaacauaacagagauaguguauuugaauaacaccaccauagagaaagagauaugccccaaauuaguggaauacagaaauuggucaaagccgcaauguaaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauugaugaaugaguuggguguuccauuucauuuaggaaccaggcaaguguguauagcaugguccagcucaaguugucacgauggaaaagcauggcugcauguuugugucacuggggaugauaaaaaugcaacugcuagcuucauuuaugacgggaggcuuguggacaguauugguucauggucucaaaauauccucaggacccaggagucggaaugcguuuguaucaaugggacuuguacaguaguaaugacugauggaagugcuucaggaagagcugauacuaaaauacuauucauugaagaggggaaaauuguccauauuagcccauugucaggaagugcucagcauguagaggaguguuccuguuauccucgauauccuggcgucagauguaucugcagagacaacuggaaaggcucuaauaggcccgucguagauauaaauguggaagauuauagcauugauuccaguuaugugugcucagggcuuguuggcgacacacccagaaacaacgacagaucuagcaauagcaauugcaggaauccuaacaaugagagagggaaucacggagugaaaggcugggccuuugacgauggaaaugacguguggaugggaagaacgaucagcaaggauuuacgcucagguuaugaaaccuucaaagucauuggugguugguccacaccuaauuccaaaucgcagauaaauaggcaagucauaguugacagcgauaauaggucagguuauucugguauuuucucuguugagggcaaaagcugcaucaauaggugcuuuuauguggaguuaauaaggggaagggaacaggagacuagaguaugguggaccucaaacaguauuguuguguuuuguggcacuucagguaccuaugggacaggcucauggccugauggggcggacaucaaucucaugccuauauaa

SEQ ID NO: 50634 - RNA, 1410 nt, Artificial Sequence
  neuraminidase__InfluenzaA__ADT79121
augaauccaaaucaaaagauaauaacaauuggcucugucucucucaccauugcaacaguaugcuuccucaugcagauugccauccuggcaacuacugugacauugcauuuuaaacaacaugagugcgacucccccgcgagcaaccaaguaaugccaugugaaccaauaauaauagaaaggaacauaacagagauaguguauuugaauaacaccaccauagagaaagagauuugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaauggcacaauacaugauagaaucccucaccgaacccuauuaaugaaugaguuggguguuccauuucauuuaggaaccaaacaaguguguguagcaugguccagcucaaguugucacgauggaaaagcaugguugcauguuugugucacuggggaugauagaaaugcgacugcuagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaauguuccuguuacccucgauauccugacgucagauguaucugcagagacaacuggaaaggcucuaauaggcccguuauagacauaaauauggaagauuauagcauugauuccaguuaugugugcucagggcuuguuggcgacacacccaggaacgacgacagcucuagcaauagcaauugcagggauccuaacaaugagagagggaauccaggagugaaaggcugggccuuugacaauggagaugauguauggaugggaagaacaaucaacaaagauucacgcucaggcuaugaaacuuucaaagucauuggugguugguccacaccuaauuccaaaucgcaggucaauagacaggucauaguugacaacaauaauuggucugguuacucugguauuuucucuguugagggcaaaagcugcaucaauaggugcuuuuauguggaguugauaaggggaaggccacaggagacuagaguaugguggaccucaaacaguauuguuguguuuuguggcacuucagguacuuauggaacaggcucauggccugauggggcgaacaucaauuucaugccuauauaa

SEQ ID NO: 50635 - RNA, 1410 nt, Artificial Sequence
  neuraminidase__InfluenzaA__ADT79131
augaauccaaaucaaaagauaauaacaauuggcucugucucucucaccauugcaacaguaugcuuccucaugcagauugccauccuggcaacuacugugacauugcauuuuaagcaacaugagugcgacucccccgcgagcaaccaaguaaugccaugugaaccaauaauaauagaaaggaacauaacagagauaguguauuugaauaacaccaccauagagaaagagauuugccccgaaguaguagaauacagaaauuggucaaagccgcaaugucaaauuacaggauuugcaccuuucucuaaggacaauucaauccggcuuucugcugguggggacauuugggugacgagagaaccuuaugugucaugugauccuggcaaguguuaucaauuugcacucgggcaggggaccacacuagacaacaaacauucaaauggcacaauacaugauagaaucccucaucgaacccuauuaaugaaugaguuggguguuccauuucauuuaggaaccaaacaaguguguguagcaugguccagcucaaguugccacgauggaaaagcaugguugcauguuugugucacuggggaugauagaaaugcaacugcuagcuucauuuaugacgggaggcuugaggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaguguuccuguuacccucgauauccugacgucagauguaucugcagagacaacuggaaaggcucuaauaggcccguuuuagacauaaguauggaagauuauagcauugauuccaguuaugugugcucagggcuuguuggcgacacacccaggaacgacgacagcucuagcaauagcaacugcagggauccuaacaaugagagagggaauccaggagugaaaggcugggccuuugacaauggagaugauguauggaugggaagaacaaucagcaaagauuuacgcucagguuaugaaacuuucaaagucauuggugguugguccacaccuaacuccaaaucgcaggucaauagacaggucauaguggacaacaauaauuggucugguuacucugguauuuucucuguugagggcaaaagcugcaucaauaggugcuuuuauguggaguugauaaggggaaggucacaggagacuagaguaugguggaccucaaacaguauuguuguguucuguggcacuucagguacuuauggaacaggcucauggccugauggggcgaacaucaauuucaugccuauauaa

SEQ ID NO: 50636 - RNA, 1410 nt, Artificial Sequence
  neuraminidase__InfluenzaA__ADT79234
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucaguugcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauauauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcaucuccuuuugugguguaaacagugacacuguggguuggucuuggccagacggugcugaguugccauuuaccauugacaaguaa

SEQ ID NO: 50637 - RNA, 1410 nt, Artificial Sequence; identical to SEQ ID NO: 47241
  neuraminidase__InfluenzaA__ADT79244

SEQ ID NO: 50638 - RNA, 1410 nt, Artificial Sequence
  neuraminidase__InfluenzaA__ADU25480
augaauccaaaucagaagauaauaaucauuaguucgaucuguuugauaaauggaauuacuagcuugauauuacaaauugggaacauaaucucaauauggauuagccauucaauucaaauugggaaccaaaaucagacugaaacaugcagccaaaacaucauuacuuaugaaaacaacacuuggguaaaucagacauauguuaacaucagcaacaacaauuuuguugcugaacaggcaguugucucaaugaaguuagcgggcaguucgccucucugccccguuagugggugggcuauauacaguaaagauaacaguguaagaaucgguuccaagggggauguguuugucauaagagagccauucaucucaugcucccacuuggaauguagaaccuucuucuugacucaaggggcccugcugaaugacaaacauucuaauggaaccauuaaagacagaagccccuaccgaacccugaugagcugcccuauuggugaaguccccucuccauacaacucaagauuugagucaguugcuuggucagcaagugcuugccaugauggaaccaguugguugacgauuggaauuucuggcccagacaauggggcaguggcuguauugaaauacaaugacauaaucacagacacuaucaagaguuggagaaauaacauauugagaacacaagagucugaauguguaugcguaaauggcucuugcuuuacuguaaugaccgauggaccaaguaaugggcaggccucguacaagaucuucaaaauagaaaaggggaaaguagucaaaucagucgaguugaaugccccuaauuaucacuaugaggaauguuccuguuauccugauucuggugaaaucauaugugugugcagggacaauuggcauggaucgaaucgaccgugggugucuuucaaucagaaucuggaguaucaaauaggauacauaugcaguggaauucucggagauaauccccgcccuaaugauagaacaggcaguugugguccaguaucacuuaauggagcuaaugggguaaaaggguuuucguucaaauacggcaaugguguuuggauagggagaacuaaaagcaguaguucaaggagcgguuuugagaugauuugggauccaaacggauggacugagacagacaauaacuucuuaguaaagcaagauaucguagggaugacugacuggucaggauacaguggcaguuuuguucagcauccagaacuaaccgggaugaauuguaugagaccuugcuucuggguugaacugaucagagggcgacccaaagagaacacaaucuggacuagcgggagcagcauauccuuuugugguguaaauagugauacuguggauuggucuuggccagacggugcugaguugccauuuaccauugacaaguaa

SEQ ID NO: 50639 - RNA, 1410 nt, Artificial Sequence
  neuraminidase__InfluenzaA__ADU59780
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuacuauugacaaguaa

SEQ ID NO: 50640 - RNA, 1410 nt, Artificial Sequence
  neuraminidase__InfluenzaA__ADU59789
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacgucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50641 - RNA, 1410 nt, Artificial Sequence; identical to SEQ ID NO: 47242
  neuraminidase__InfluenzaA__ADU59829

SEQ ID NO: 50642 - RNA, 1410 nt, Artificial Sequence
  neuraminidase__InfluenzaA__ADU59838
augaauccaaaccaaaagauaauaaucauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuuugaggaaugcuccuguuauccugauucuagugaaaucacaugugugugcagggauaacuggcaugguucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggauuggucuuggccagacggugcugaguugccauuuaccauugacaaguaa

SEQ ID NO: 50643 - RNA, 1410 nt, Artificial Sequence; identical to SEQ ID NO: 48668
  neuraminidase__InfluenzaA__ADU59847

SEQ ID NO: 50644 - RNA, 1410 nt, Artificial Sequence
  neuraminidase__InfluenzaA__ADU59907
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacucuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50645 - RNA, 1410 nt, Artificial Sequence; identical to SEQ ID NO: 47242
  neuraminidase__InfluenzaA__ADU59917

SEQ ID NO: 50646 - RNA, 1410 nt, Artificial Sequence; identical to SEQ ID NO: 47242
  neuraminidase__InfluenzaA__ADU59920

SEQ ID NO: 50647 - RNA, 1410 nt, Artificial Sequence; identical to SEQ ID NO: 47242
  neuraminidase__InfluenzaA__ADU59941

SEQ ID NO: 50648 - RNA, 1410 nt, Artificial Sequence
  neuraminidase__InfluenzaA__ADU76311
augaauccaaaccaaaagauaauaaccauugguucggucuguaugacaauuggaauggcuaacuuaauauuacaaauuggaaacauaaucucaauauggauuagccacucaauucaacuugggaaucaaaaucaaauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggagcaguggcuguguuaaaguacaacggcauaauaacagacaccaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcuaaguugccauuuaccauugacaaguaa

SEQ ID NO: 50649 - RNA, 1410 nt, Artificial Sequence
  neuraminidase__InfluenzaA__ADU76313
augaauccaaaccaaaagauaauaaccauugguucggucuguaugacaauuggaauggcuaacuuaauauuacaaauuggaaacauaaucucaauauggauuagccacucaauucaacuugggaaucaaaaucaaauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggagcaguggcuguguuaaaguacaacggcauaauaacagacaccaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcuaaguugccauuuaccauugacaaguaa

SEQ ID NO: 50650 - RNA, 1410 nt, Artificial Sequence; identical to SEQ ID NO: 50649
  neuraminidase__InfluenzaA__ADU76314

SEQ ID NO: 50651 - RNA, 1410 nt, Artificial Sequence; identical to SEQ ID NO: 50649
  neuraminidase__InfluenzaA__ADU76315

SEQ ID NO: 50652 - RNA, 1410 nt, Artificial Sequence; identical to SEQ ID NO: 50649
  neuraminidase__InfluenzaA__ADU76316

SEQ ID NO: 50653 - RNA, 1410 nt, Artificial Sequence
  neuraminidase__InfluenzaA__ADU76317
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcacuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50654 - RNA, 1410 nt, Artificial Sequence
  neuraminidase__InfluenzaA__ADU76318
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccauaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50655 - RNA, 1410 nt, Artificial Sequence
  neuraminidase__InfluenzaA__ADU76319
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaaugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50656 - RNA, 1410 nt, Artificial Sequence; identical to SEQ ID NO: 47707
  neuraminidase__InfluenzaA__ADU76320

SEQ ID NO: 50657 - RNA, 1410 nt, Artificial Sequence
  neuraminidase__InfluenzaA__ADU76321
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacucuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50658 - RNA, 1410 nt, Artificial Sequence
  neuraminidase__InfluenzaA__ADU76322
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagguagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcaucauauccuuuugugguguaaacagugacacuguggguuggucuuggccggacggugcugaguugccauuuaccauugacaaguaa

SEQ ID NO: 50659 - RNA, 1410 nt, Artificial Sequence; identical to SEQ ID NO: 50648
  neuraminidase__InfluenzaA__ADU76323

SEQ ID NO: 50660 - RNA, 1410 nt, Artificial Sequence; identical to SEQ ID NO: 50649
  neuraminidase__InfluenzaA__ADU76324

SEQ ID NO: 50661 - RNA, 1410 nt, Artificial Sequence; identical to SEQ ID NO: 50648
  neuraminidase__InfluenzaA__ADU76325

SEQ ID NO: 50662 - RNA, 1410 nt, Artificial Sequence; identical to SEQ ID NO: 50649
  neuraminidase__InfluenzaA__ADU76326

SEQ ID NO: 50663 - RNA, 1410 nt, Artificial Sequence; identical to SEQ ID NO: 50649
  neuraminidase__InfluenzaA__ADU76327

SEQ ID NO: 50664 - RNA, 1410 nt, Artificial Sequence; identical to SEQ ID NO: 50648
  neuraminidase__InfluenzaA__ADU76328

SEQ ID NO: 50665 - RNA, 1410 nt, Artificial Sequence; identical to SEQ ID NO: 50649
  neuraminidase__InfluenzaA__ADU76329

SEQ ID NO: 50666 - RNA, 1410 nt, Artificial Sequence; identical to SEQ ID NO: 50649
  neuraminidase__InfluenzaA__ADU76330

SEQ ID NO: 50667 - RNA, 1410 nt, Artificial Sequence; identical to SEQ ID NO: 50649
  neuraminidase__InfluenzaA__ADU76331

SEQ ID NO: 50668 - RNA, 1410 nt, Artificial Sequence; identical to SEQ ID NO: 50649
  neuraminidase__InfluenzaA__ADU76332

SEQ ID NO: 50669 - RNA, 1410 nt, Artificial Sequence; identical to SEQ ID NO: 47439
  neuraminidase__InfluenzaA__ADU76333

SEQ ID NO: 50670 - RNA, 1410 nt, Artificial Sequence; identical to SEQ ID NO: 47439
  neuraminidase__InfluenzaA__ADU76334

SEQ ID NO: 50671 - RNA, 1410 nt, Artificial Sequence; identical to SEQ ID NO: 47707
  neuraminidase__InfluenzaA__ADU76335

SEQ ID NO: 50672 - RNA, 1410 nt, Artificial Sequence; identical to SEQ ID NO: 50649
  neuraminidase__InfluenzaA__ADU76336

SEQ ID NO: 50673 - RNA, 1410 nt, Artificial Sequence
  neuraminidase__InfluenzaA__ADU76337
augaauccaaaccaaaagauaauaaccauugguucggucuguauaacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggagccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50674 - RNA, 1410 nt, Artificial Sequence; identical to SEQ ID NO: 49942
  neuraminidase__InfluenzaA__ADU76338

SEQ ID NO: 50675 - RNA, 1410 nt, Artificial Sequence; identical to SEQ ID NO: 50648
  neuraminidase__InfluenzaA__ADU76339

SEQ ID NO: 50676 - RNA, 1410 nt, Artificial Sequence; identical to SEQ ID NO: 47306
  neuraminidase__InfluenzaA__ADU76341

SEQ ID NO: 50677 - RNA, 1410 nt, Artificial Sequence; identical to SEQ ID NO: 50657
  neuraminidase__InfluenzaA__ADU76342

SEQ ID NO: 50678 - RNA, 1410 nt, Artificial Sequence; identical to SEQ ID NO: 50657
  neuraminidase__InfluenzaA__ADU76343

SEQ ID NO: 50679 - RNA, 1410 nt, Artificial Sequence; identical to SEQ ID NO: 50649
  neuraminidase__InfluenzaA__ADU76344

SEQ ID NO: 50680 - RNA, 1410 nt, Artificial Sequence; identical to SEQ ID NO: 50649
  neuraminidase__InfluenzaA__ADU76345

SEQ ID NO: 50681 - RNA, 1410 nt, Artificial Sequence
  neuraminidase__InfluenzaA__ADU76346
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacucuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggguuuucauucaaauacggcaaugguguuuggauagggagaacuaaaagcauuaguucaagaaacgguuuugagaugauuugggauccgaacggauggacugagacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50682 - RNA, 1410 nt, Artificial Sequence; identical to SEQ ID NO: 50673
  neuraminidase__InfluenzaA__ADU76347

SEQ ID NO: 50683 - RNA, 1410 nt, Artificial Sequence
  neuraminidase__InfluenzaA__ADV17285
augaauccaaaccaagagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaaccuuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauaguuaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucagauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50684 - RNA, 1410 nt, Artificial Sequence
  neuraminidase__InfluenzaA__ADV17295
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacgaucuggacuagcgggagcagcauauccuuuugcgguguaaacagugacacuguggguuggucuuggccagacggugcugaguugccauuuaccauugacaaguaa

SEQ ID NO: 50685 - RNA, 1410 nt, Artificial Sequence
  neuraminidase__InfluenzaA__ADV17305
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcuccuccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcucagacaauggggcaguggcuguguuaaaguacaacggcauaauaacagacacuaucaagaguuggagaaacaauauauugagaacacaagagucugaaugugcauguguaaaugguucuugcuuuacuauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50686 - RNA, 1410 nt, Artificial Sequence
  neuraminidase__InfluenzaA__ADV17315
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauaguuaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50687 - RNA, 1410 nt, Artificial Sequence
  neuraminidase__InfluenzaA__ADV17325
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacuggaacagacaauagcuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50688 - RNA, 1410 nt, Artificial Sequence
  neuraminidase__InfluenzaA__ADV17335
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauaguuaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggguuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugagugcccauuuaccauugacaaguaa

SEQ ID NO: 50689 - RNA, 1410 nt, Artificial Sequence; identical to SEQ ID NO: 48319
  neuraminidase__InfluenzaA__ADV19022

SEQ ID NO: 50690 - RNA, 1410 nt, Artificial Sequence
  neuraminidase__InfluenzaA__ADV41679
augaauccaaaccaaaagauaauaaccauugguucggucuguaugacaauuggaauggcuaacuuaauauuacaaauuggaaacauaaucucaauauggauuagccacucaauucaacuuaggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaugguuuugagaugauuugggauccgaacggauggacugggacagacaauaacuucucaauaaagcaagauaucgugggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50691 - RNA, 1410 nt, Artificial Sequence
  neuraminidase__InfluenzaA__ADV76582
augaauccaaaucaaaagauaauaacgauuggcucuguuucucucaccauuuccacaguaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacaaagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 50692 - RNA, 1410 nt, Artificial Sequence; identical to SEQ ID NO: 48087
  neuraminidase__InfluenzaA__ADV76590

SEQ ID NO: 50693 - RNA, 1410 nt, Artificial Sequence; identical to SEQ ID NO: 48087
  neuraminidase__InfluenzaA__ADV76601

SEQ ID NO: 50694 - RNA, 1410 nt, Artificial Sequence; identical to SEQ ID NO: 49795
  neuraminidase__InfluenzaA__ADV76612

SEQ ID NO: 50695 - RNA, 1410 nt, Artificial Sequence; identical to SEQ ID NO: 48087
  neuraminidase__InfluenzaA__ADV76623

SEQ ID NO: 50696 - RNA, 1410 nt, Artificial Sequence
  neuraminidase__InfluenzaA__ADV76634
augaauccaaaucaaaagauaauaacuauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuugcacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguggauauaaacauaaaggaucauagcauuguuuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50697 - RNA, 1410 nt, Artificial Sequence; identical to SEQ ID NO: 49970
  neuraminidase__InfluenzaA__ADV76645

SEQ ID NO: 50698 - RNA, 1410 nt, Artificial Sequence
  neuraminidase__InfluenzaA__ADV76667
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgaucauggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaaaagcaggaauccuaacaaugagagagggaaucaaggagugaaaggcugggccuuugacaauggagaugacguguggaugggaagaacgaucagcagggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagagugugguggaccucaaacaguauuguuguguuuuguggcacuucagguaccuauggaacaggcucauggccugauggggcgaacaucaauuucaugccuauauaa

SEQ ID NO: 50699 - RNA, 1410 nt, Artificial Sequence; identical to SEQ ID NO: 49972
  neuraminidase__InfluenzaA__ADV76676

SEQ ID NO: 50700 - RNA, 1410 nt, Artificial Sequence
  neuraminidase__InfluenzaA__ADV76697
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaaaaaacauaacagagauaguguaucugaccaacaccaccauagagaaggaaauaugccccaaacuagcagaauacagaaauuggucaaagccgcaaugugacauuacaggguuugcaccuuuuucuaaggacaauucaauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugagggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50701 - RNA, 1410 nt, Artificial Sequence
  neuraminidase__InfluenzaA__ADV76708
augaauccaaaucaaaagauaauaacgauuggcucuguuucucucaccauuuccacaauauguuucuucaugcaaaccgccauccugauaacuacuguaacauugcauuucaagcaaugugaauucaacucccccccaaacaaccaagugaugcugugugaaccaacaauaauagaaagaaacauaacagagauaguguaucugaccaacaucaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacgcuaaacaacgugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuaguuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaaaucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaaggaaagaggaaacugaagucuuguggaccucaaacaguauuguuguguuuuguggcaccucagguacauauggaacaggcucauggccugauggggcggacaucaaucucaugccuauauaa

SEQ ID NO: 50702 - RNA, 1410 nt, Artificial Sequence
  neuraminidase__InfluenzaA__ADV76719
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaaaaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugacacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagaugaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50703 - RNA, 1410 nt, Artificial Sequence
  neuraminidase__InfluenzaA__ADV76730
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaacccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaagacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguauuuuguggcaccucagguacauauggaacaggcucauggccugauggggcggacaucaaucucaugccuauauaa

SEQ ID NO: 50704 - RNA, 1410 nt, Artificial Sequence
  neuraminidase__InfluenzaA__ADV78132
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuugguuaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccucggaaugcagaaccuucuucuugacucaaggggccuuacuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagaaucugaaugugcauguguaaaugguucuugcuuuaccauaaugaccgauggaccaagugauggacaggccucauacaagaucuucagaauagaaaagggaaagauagucaaaucagucggaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucugggcuagcgggagcagcauauccuuuugugguguaaacagugacacuguggguuggucuuggccagacggugcugaguugccauuuaucauugacaaguaa

SEQ ID NO: 50705 - RNA, 1413 nt, Artificial Sequence
  neuraminidase__InfluenzaA__ADW09104
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaauaauaaagccgccucguacaaaauuuucaagaucgaaaaggggaagguuacuaaaucaauagaguugaaugcacccaauuuuuauuacgaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50706 - RNA, 1413 nt, Artificial Sequence
  neuraminidase__InfluenzaA__ADW09114
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuacgaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50707 - RNA, 1413 nt, Artificial Sequence
  neuraminidase__InfluenzaA__ADW09123
augaacccaaaucaaaagauaauaaccauuggaucaaucaguauagcaaucggaauaaccagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuacgaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguugauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50708 - RNA, 1413 nt, Artificial Sequence
  neuraminidase__InfluenzaA__ADW09156
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuacgaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguugauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50709 - RNA, 1413 nt, Artificial Sequence
  neuraminidase__InfluenzaA__ADW09167
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuacgaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguuaauggagcagacggagugaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50710 - RNA, 1413 nt, Artificial Sequence
  neuraminidase__InfluenzaA__ADW09178
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuacgaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccccgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuugugguguuaauagugauacugcaaacuggucuuggccagacggugcugaguugccguucaccauugacaaguag

SEQ ID NO: 50711 - RNA, 1413 nt, Artificial Sequence; identical to SEQ ID NO: 50706
  neuraminidase__InfluenzaA__ADW09189

SEQ ID NO: 50712 - RNA, 1413 nt, Artificial Sequence
  neuraminidase__InfluenzaA__ADW09211
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuacgaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguuaauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50713 - RNA, 1413 nt, Artificial Sequence
  neuraminidase__InfluenzaA__ADW09222
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuucuauuacgaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauucagugacuguugauggagcagacggaguaaaaggguuuucauacaaauaugguaaugguguuuggauaggaaggaccaaaaguaacagacuuagaaagggguuugagaugauuugggauccuaauggguggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50714 - RNA, 1413 nt, Artificial Sequence
  neuraminidase__InfluenzaA__ADW09233
augaacccaaaucaaaagauaauaaccauuggaucaaucaguauagcaaucggaacaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaagcuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuacgaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50715 - RNA, 1413 nt, Artificial Sequence
  neuraminidase__InfluenzaA__ADW09244
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuacgaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguugauggagcagacggaguaaaaggguuuucauacaaauaugguaaugguguuuggauaggaaggaccaaaaguaacagacuuagaaagggguuugagaugauuugggauccuaauggguggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50716 - RNA, 1413 nt, Artificial Sequence; identical to SEQ ID NO: 50708
  neuraminidase__InfluenzaA__ADW09255

SEQ ID NO: 50717 - RNA, 1413 nt, Artificial Sequence; identical to SEQ ID NO: 50708
  neuraminidase__InfluenzaA__ADW09266

SEQ ID NO: 50718 - RNA, 1413 nt, Artificial Sequence; identical to SEQ ID NO: 50708
  neuraminidase__InfluenzaA__ADW09277

SEQ ID NO: 50719 - RNA, 1413 nt, Artificial Sequence
  neuraminidase__InfluenzaA__ADW09288
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaagcuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuacgaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50720 - RNA, 1413 nt, Artificial Sequence; identical to SEQ ID NO: 50712
  neuraminidase__InfluenzaA__ADW09299

SEQ ID NO: 50721 - RNA, 1413 nt, Artificial Sequence; identical to SEQ ID NO: 50706
  neuraminidase__InfluenzaA__ADW09310

SEQ ID NO: 50722 - RNA, 1413 nt, Artificial Sequence
  neuraminidase__InfluenzaA__ADW09330
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50723 - RNA, 1413 nt, Artificial Sequence; identical to SEQ ID NO: 50708
  neuraminidase__InfluenzaA__ADW10475

SEQ ID NO: 50724 - RNA, 1413 nt, Artificial Sequence; identical to SEQ ID NO: 50712
  neuraminidase__InfluenzaA__ADW10486

SEQ ID NO: 50725 - RNA, 1413 nt, Artificial Sequence; identical to SEQ ID NO: 50706
  neuraminidase__InfluenzaA__ADW10497

SEQ ID NO: 50726 - RNA, 1413 nt, Artificial Sequence
  neuraminidase__InfluenzaA__ADW10508
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacguccgugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuaguaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaauccauagaguugaaugcacccaauuuuuauuacgaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguuaauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50727 - RNA, 1413 nt, Artificial Sequence
  neuraminidase__InfluenzaA__ADW10519
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuacgaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaggauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50728 - RNA, 1413 nt, Artificial Sequence
  neuraminidase__InfluenzaA__ADW10530
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuacgaggaaugcuccuguuacccagacacuggcauagugauguguguaugcagggacaacuggcaugguucaaaucgaccuugggugucuuuuaaucaaaauuuggauuaucaaauaggauacaucugcaguggaguuuuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50729 - RNA, 1413 nt, Artificial Sequence
  neuraminidase__InfluenzaA__ADW10541
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaagcuggaaaaagcaaauauuaagaacacaagagucugaaugugucuguauggacgggucauguuucaccauaaugaccgauggcccgaguaauaaagccgccucguacaaaauuuucaagaucgaaaaggggaagguuacuaaaucaauagaguugaaugcacccaauuuuuauuacgaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguugauggagcaaauggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50730 - RNA, 1413 nt, Artificial Sequence
  neuraminidase__InfluenzaA__ADW10552
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccgauuuuuauuacgaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguuaauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50731 - RNA, 1413 nt, Artificial Sequence
  neuraminidase__InfluenzaA__ADW10563
augaacccaaaucaacggauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucauacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccgcaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccggugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacacccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50732 - RNA, 1413 nt, Artificial Sequence; identical to SEQ ID NO: 50289
  neuraminidase__InfluenzaA__ADW10574

SEQ ID NO: 50733 - RNA, 1413 nt, Artificial Sequence
  neuraminidase__InfluenzaA__ADW10585
augaacccaaaucaaaagauaauaaccauuggaucaaucaguauagcaaucggaauaauuagucuaauguugcaaauaggaaguauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaaaaucagugacauuggccggcaauucaucucuuuguucuaucaguggaugggcuauauacacaaaagacaacaguauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaauucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggaauaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucacuauugacaaguag

SEQ ID NO: 50734 - RNA, 1413 nt, Artificial Sequence
  neuraminidase__InfluenzaA__ADW10596
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuacgaggaaugcuccuguuacccagacacuggcauagugauguguguaugcagggacaacuggcaugguucaaaucgaccuugggugucuuuuaaccaaaauuuggauuaucaaauaggauacaucugcaguggaguguuuggugacaauccgcgucccgaagauggagagggcagcugcaauccagugacuguuaauggagcagacggagugaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50735 - RNA, 1413 nt, Artificial Sequence; identical to SEQ ID NO: 50715
  neuraminidase__InfluenzaA__ADW10607

SEQ ID NO: 50736 - RNA, 1413 nt, Artificial Sequence
  neuraminidase__InfluenzaA__ADW10618
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuacgaggaaugcuccuguuauccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguugauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50737 - RNA, 1413 nt, Artificial Sequence; identical to SEQ ID NO: 50715
  neuraminidase__InfluenzaA__ADW10629

SEQ ID NO: 50738 - RNA, 1413 nt, Artificial Sequence; identical to SEQ ID NO: 50708
  neuraminidase__InfluenzaA__ADW10724

SEQ ID NO: 50739 - RNA, 1413 nt, Artificial Sequence
  neuraminidase__InfluenzaA__ADW10735
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaaguuggaaaaagcaaauauuaagaacacaagaaucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuacgaggaaugcuccuguuacccagacacuggcauagugauguguguaugcagggacaacuggcaugguucaaaucgaccuugggugucuuuuaaccaaaauuuggauuaucaaauaggauacaucugcaguggaguguuuggugacaauccgcgucccgaagauggagagggcagcugcaauccagugacuguuaauggagcagacggagugaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50740 - RNA, 1413 nt, Artificial Sequence; identical to SEQ ID NO: 50739
  neuraminidase__InfluenzaA__ADW10746

SEQ ID NO: 50741 - RNA, 1413 nt, Artificial Sequence
  neuraminidase__InfluenzaA__ADW10757
augaacccaaaucaaaagauaauaaccauuggaucaaucaguauagcaaucggaauaauuagucugauguugcaaauaggaaauauuauuucaauaugggcuagucacucaauccaaacuaggagucaaaacaacacuggaauaugcaaccaaagaaucaucacauaugaaaacagcaccugggugaaucacacauauguuaauauuaacaacacuaauguuguugcuggaggggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucacccuaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagagacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50742 - RNA, 1413 nt, Artificial Sequence; identical to SEQ ID NO: 50708
  neuraminidase__InfluenzaA__ADW10768

SEQ ID NO: 50743 - RNA, 1413 nt, Artificial Sequence; identical to SEQ ID NO: 50706
  neuraminidase__InfluenzaA__ADW10779

SEQ ID NO: 50744 - RNA, 1413 nt, Artificial Sequence
  neuraminidase__InfluenzaA__ADW10790
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuacgaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaggauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaauaccuugcuucuggguugaguuagucagagggcugccuagagaaaaugcgacaaucuggacuagugggagcagcauuucuuuuuguggcguuaauagugauacugcaaacuggucuuggccagacggugcugaguugccguucaccauugacaaguag

SEQ ID NO: 50745 - RNA, 1413 nt, Artificial Sequence
  neuraminidase__InfluenzaA__ADW10801
augaacccaaaucaaaagauaauaaccauuggaucaaucaguauagcaaucggaauaauuagucuaauguugcaaauaggaaguauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguagauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaauugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50746 - RNA, 1413 nt, Artificial Sequence; identical to SEQ ID NO: 50708
  neuraminidase__InfluenzaA__ADW10812

SEQ ID NO: 50747 - RNA, 1413 nt, Artificial Sequence
  neuraminidase__InfluenzaA__ADW10823
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauauuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuacgaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguuaauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50748 - RNA, 1413 nt, Artificial Sequence
  neuraminidase__InfluenzaA__ADW10834
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuauuaaaucaauagaguugaaugcacccaauuuuuauuacgaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50749 - RNA, 1413 nt, Artificial Sequence; identical to SEQ ID NO: 50712
  neuraminidase__InfluenzaA__ADW10845

SEQ ID NO: 50750 - RNA, 1413 nt, Artificial Sequence
  neuraminidase__InfluenzaA__ADW10856
augaacccaaaucaaaggauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucauacauauguuaauauuaacaacacuaauguuguugcuggagaggacaaaacgucaaugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccgcaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgagcaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccggugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacacccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 50751 - RNA, 1413 nt, Artificial Sequence; identical to SEQ ID NO: 50708
  neuraminidase__InfluenzaA__ADW10867

SEQ ID NO: 50752 - RNA, 1413 nt, Artificial Sequence; identical to SEQ ID NO: 50708
  neuraminidase__InfluenzaA__ADW10878

SEQ ID NO: 50753 - RNA, 1413 nt, Artificial Sequence; identical to SEQ ID NO: 50708
  neuraminidase__InfluenzaA__ADW10889

SEQ ID NO: 50754 - RNA, 1413 nt, Artificial Sequence
  neuraminidase__InfluenzaA__ADW10900
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucugcaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguauuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 50755 - RNA, 1410 nt, Artificial Sequence; identical to SEQ ID NO: 49746
  neuraminidase__InfluenzaA__ADW11155

SEQ ID NO: 50756 - RNA, 1410 nt, Artificial Sequence; identical to SEQ ID NO: 47445
  neuraminidase__InfluenzaA__ADW23530

SEQ ID NO: 50757 - RNA, 1410 nt, Artificial Sequence
  neuraminidase__InfluenzaA__ADW54483
augaauccaaaccaaaagauaauaaccauugguucggucuguaugacaauuggaauggcuaacuuaauguuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50758 - RNA, 1410 nt, Artificial Sequence
  neuraminidase__InfluenzaA__ADW54494
augaauccaaaucaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucggauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucgagaaacgguuuugagaugauuugggauccgaacggauggacugggacagacaauaacuucucaauaaagcaagauaucauaggaauaaaugaguggucaggauauagcgggaguuuuguucagcauccagaacuaacagggcuggauuguauaagaccuugcuuuuggguugaacuaaucagagggcggcccaaagagaauacaaucuggacuagcgggagcagcauauccuuuugugguguaaacagugacacuguggguuggucuuggccagacggugcugaguugccauuuaccauugacaaguaa

SEQ ID NO: 50759 - RNA, 1410 nt, Artificial Sequence
  neuraminidase__InfluenzaA__ADW54514
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugaugguaucaauuggcuaacaauuggaauuucuggcccagacaauggggcaguggcuguguuaaaguacaacggcauaauaacagacacuaucaagaguuggaaaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucggauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggacccgaacggauggacugggacagacaauaacuucucaaaaaagcaagauaucauaggaauaaaugaguggucaggauauagcgggaguuuuguucagcauccagaacuaacagggcuggauuguauaagaccuugcuucuggguugaacuaaucagagggcggcccaaagagaacacaaucuggacuagcgggagcagcauauccuuuugugguguaaacagugacacuguggguuggucuuggccagacggugcugaguugccauuuaccauugacaaguaa

SEQ ID NO: 50760 - RNA, 1410 nt, Artificial Sequence
  neuraminidase__InfluenzaA__ADW54522
augaauccaaaccaaaagauaauaaccauugguucggucuguaugauaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauagauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagaggacgacccaaagagaacacaaucuggacuagcgggagcagcauauccuuuugugguguaaacagugacacuguggguuggucuuggccagacggugcugaguugccauuuaccauugacaaguaa

SEQ ID NO: 50761 - RNA, 1410 nt, Artificial Sequence
  neuraminidase__InfluenzaA__ADW65826
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuuuucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50762 - RNA, 1410 nt, Artificial Sequence
  neuraminidase__InfluenzaA__ADW80519
augaauccaaaucaaaagauaauaacuauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauuguuuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50763 - RNA, 1410 nt, Artificial Sequence
  neuraminidase__InfluenzaA__ADW82127
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggguuugcaccuuuuucuaaggacaauucgauuaggcuuuccgcugguggggacaucugggugacaagagaaccuuauguuucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaagaaacugaagucuuguggaccucaaacaguauuguuguguuuuguggcaccucagguacauauggaacaggcucauggccugauggggcggacaucaaucucaugccuauauaa

SEQ ID NO: 50764 - RNA, 1410 nt, Artificial Sequence; identical to SEQ ID NO: 50763
  neuraminidase__InfluenzaA__ADW82138

SEQ ID NO: 50765 - RNA, 1410 nt, Artificial Sequence; identical to SEQ ID NO: 50763
  neuraminidase__InfluenzaA__ADW82149

SEQ ID NO: 50766 - RNA, 1410 nt, Artificial Sequence; identical to SEQ ID NO: 50763
  neuraminidase__InfluenzaA__ADW82158

SEQ ID NO: 50767 - RNA, 1410 nt, Artificial Sequence; identical to SEQ ID NO: 50763
  neuraminidase__InfluenzaA__ADW82169

SEQ ID NO: 50768 - RNA, 1410 nt, Artificial Sequence; identical to SEQ ID NO: 50763
  neuraminidase__InfluenzaA__ADW82180

SEQ ID NO: 50769 - RNA, 1410 nt, Artificial Sequence; identical to SEQ ID NO: 47242
  neuraminidase__InfluenzaA__ADW82191

SEQ ID NO: 50770 - RNA, 1410 nt, Artificial Sequence; identical to SEQ ID NO: 47242
  neuraminidase__InfluenzaA__ADW82201

SEQ ID NO: 50771 - RNA, 1410 nt, Artificial Sequence; identical to SEQ ID NO: 47242
  neuraminidase__InfluenzaA__ADW82211

SEQ ID NO: 50772 - RNA, 1410 nt, Artificial Sequence; identical to SEQ ID NO: 47242
  neuraminidase__InfluenzaA__ADW82221

SEQ ID NO: 50773 - RNA, 1410 nt, Artificial Sequence; identical to SEQ ID NO: 47242
  neuraminidase__InfluenzaA__ADW82231

SEQ ID NO: 50774 - RNA, 1410 nt, Artificial Sequence; identical to SEQ ID NO: 47242
  neuraminidase__InfluenzaA__ADW82241

SEQ ID NO: 50775 - RNA, 1410 nt, Artificial Sequence; identical to SEQ ID NO: 47242
  neuraminidase__InfluenzaA__ADW82251

SEQ ID NO: 50776 - RNA, 1410 nt, Artificial Sequence; identical to SEQ ID NO: 47242
  neuraminidase__InfluenzaA__ADW82261

SEQ ID NO: 50777 - RNA, 1410 nt, Artificial Sequence; identical to SEQ ID NO: 47242
  neuraminidase__InfluenzaA__ADW82271

SEQ ID NO: 50778 - RNA, 1410 nt, Artificial Sequence
  neuraminidase__InfluenzaA__ADW95306
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguagcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50779 - RNA, 1410 nt, Artificial Sequence; identical to SEQ ID NO: 50778
  neuraminidase__InfluenzaA__ADW95313

SEQ ID NO: 50780 - RNA, 1410 nt, Artificial Sequence; identical to SEQ ID NO: 50778
  neuraminidase__InfluenzaA__ADW95320

SEQ ID NO: 50781 - RNA, 1410 nt, Artificial Sequence; identical to SEQ ID NO: 50778
  neuraminidase__InfluenzaA__ADW95327

SEQ ID NO: 50782 - RNA, 1410 nt, Artificial Sequence
  neuraminidase__InfluenzaA__ADW95333
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguagcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucuuacaagaucuuccgaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagugcuaaaagcauuaguucaagaaaagcuuuugagaugauuugggauccaaacggauggacugggacagacaauaacuucucaauaaagcaauauauaguaggaauaaaugaguggucaggauauagcgggaguuuuguugagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50783 - RNA, 1410 nt, Artificial Sequence
  neuraminidase__InfluenzaA__ADX20813
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggagccuugcuaaaugacaaacauuccaauggaaccauuaaagacaggagcccauaucgaacccuaaugagcuguccuauuggugaaguucccucuccauacaacucaagauuugaguuagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacagaccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccaugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50784 - RNA, 1410 nt, Artificial Sequence
  neuraminidase__InfluenzaA__ADX20814
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50785 - RNA, 1410 nt, Artificial Sequence; identical to SEQ ID NO: 50763
  neuraminidase__InfluenzaA__ADX21091

SEQ ID NO: 50786 - RNA, 1410 nt, Artificial Sequence; identical to SEQ ID NO: 47242
  neuraminidase__InfluenzaA__ADX21101

SEQ ID NO: 50787 - RNA, 1410 nt, Artificial Sequence
  neuraminidase__InfluenzaA__ADX36112
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucacagcauugucuccaguuauguguguucaggacuuguuggagacacacccagaaaaaacgacagcuccagcaguagccauuguucggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggauaucaaucucaugccuauauaa

SEQ ID NO: 50788 - RNA, 1410 nt, Artificial Sequence
  neuraminidase__InfluenzaA__ADX87386
augaauccaaaucaaaggauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggagggaaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuguauaa

SEQ ID NO: 50789 - RNA, 1410 nt, Artificial Sequence
  neuraminidase__InfluenzaA__ADX96270
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcaucauuacuuaugaaaacaacacuuggguaaaucagacauauguuaacaucagcaacaccaacuuugcugcuggacagucaguggcuuccgugaaauuagcgggcaauucuucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaaugggaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguuucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50790 - RNA, 1410 nt, Artificial Sequence; identical to SEQ ID NO: 50789
  neuraminidase__InfluenzaA__ADX96280

SEQ ID NO: 50791 - RNA, 1410 nt, Artificial Sequence
  neuraminidase__InfluenzaA__ADX96290
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcaggcaauucuucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguuucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50792 - RNA, 1410 nt, Artificial Sequence
  neuraminidase__InfluenzaA__ADX96300
augaauccaaaccaaaagauaauaaccauugguucggucuguaugacaauuggaauggccaacuuaauauuacaaauuggaaacauaaucucaauauggauuagccacucaauucaacuugggaaucaaaaccagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgaugggccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50793 - RNA, 1410 nt, Artificial Sequence; identical to SEQ ID NO: 47242
  neuraminidase__InfluenzaA__ADX96310

SEQ ID NO: 50794 - RNA, 1410 nt, Artificial Sequence
  neuraminidase__InfluenzaA__ADX96330
augaauccaaaccaaaagauaauaaccauugguucggucuguaugacaauuggaauggcuaacuuaauauuacaaauuggaaauggaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcaugcguaaaugguucuugcuuuacuguaaugaccgaugggccaagugauggacaggccucauacaagaucuucagaauagaaaagggaaagauagucaaaucagucgaaaugaaugccccuaauuaucacuaugaggaaugcuccuguuauccugauucuaaugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50795 - RNA, 1410 nt, Artificial Sequence
  neuraminidase__InfluenzaA__ADX96339
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgaugggccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50796 - RNA, 1410 nt, Artificial Sequence
  neuraminidase__InfluenzaA__ADX96349
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuaaugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50797 - RNA, 1410 nt, Artificial Sequence
  neuraminidase__InfluenzaA__ADX96359
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuagaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50798 - RNA, 1410 nt, Artificial Sequence; identical to SEQ ID NO: 50795
  neuraminidase__InfluenzaA__ADX96369

SEQ ID NO: 50799 - RNA, 1410 nt, Artificial Sequence
  neuraminidase__InfluenzaA__ADX96380
augaauccaaaccaaaagauaauaaccauugguucggucuguaugacaauuggaauggcuaacuuaauauuacaaauuggaaacauaaucucaauauggccaguccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccaugaaauuagcgggcaauuccucucucugcccuguugguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucgaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50800 - RNA, 1410 nt, Artificial Sequence
  neuraminidase__InfluenzaA__ADX96390
augaauccaaaccaaaagauaauaaccauugguucggucuguaugacaauuggaauggcuaacuuaauauuacaaauuggaaacauaaucucaauauggcucagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50801 - RNA, 1410 nt, Artificial Sequence; identical to SEQ ID NO: 50795
  neuraminidase__InfluenzaA__ADX96400

SEQ ID NO: 50802 - RNA, 1410 nt, Artificial Sequence
  neuraminidase__InfluenzaA__ADX96410
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugacugaugggccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50803 - RNA, 1410 nt, Artificial Sequence
  neuraminidase__InfluenzaA__ADX96419
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaggacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50804 - RNA, 1410 nt, Artificial Sequence
  neuraminidase__InfluenzaA__ADX96429
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguuucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaagaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50805 - RNA, 1410 nt, Artificial Sequence; identical to SEQ ID NO: 50304
  neuraminidase__InfluenzaA__ADX96449

SEQ ID NO: 50806 - RNA, 1410 nt, Artificial Sequence; identical to SEQ ID NO: 47242
  neuraminidase__InfluenzaA__ADX96469

SEQ ID NO: 50807 - RNA, 1410 nt, Artificial Sequence; identical to SEQ ID NO: 47242
  neuraminidase__InfluenzaA__ADX96489

SEQ ID NO: 50808 - RNA, 1410 nt, Artificial Sequence; identical to SEQ ID NO: 50304
  neuraminidase__InfluenzaA__ADX96499

SEQ ID NO: 50809 - RNA, 1410 nt, Artificial Sequence
  neuraminidase__InfluenzaA__ADX96509
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaauggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50810 - RNA, 1410 nt, Artificial Sequence; identical to SEQ ID NO: 49496
  neuraminidase__InfluenzaA__ADX96519

SEQ ID NO: 50811 - RNA, 1410 nt, Artificial Sequence; identical to SEQ ID NO: 49496
  neuraminidase__InfluenzaA__ADX96529

SEQ ID NO: 50812 - RNA, 1410 nt, Artificial Sequence
  neuraminidase__InfluenzaA__ADX96539
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccaugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50813 - RNA, 1410 nt, Artificial Sequence
  neuraminidase__InfluenzaA__ADX96549
augaauccaaaccaaaagauaauaaccauugguucggucuguaugacaauuggaauggcuaacuuaauauuacaaauuggaaacauaaucucaauauggaucagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccguaaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50814 - RNA, 1410 nt, Artificial Sequence; identical to SEQ ID NO: 47379
  neuraminidase__InfluenzaA__ADX96559

SEQ ID NO: 50815 - RNA, 1410 nt, Artificial Sequence; identical to SEQ ID NO: 47242
  neuraminidase__InfluenzaA__ADX96569

SEQ ID NO: 50816 - RNA, 1410 nt, Artificial Sequence; identical to SEQ ID NO: 47241
  neuraminidase__InfluenzaA__ADX96579

SEQ ID NO: 50817 - RNA, 1410 nt, Artificial Sequence
  neuraminidase__InfluenzaA__ADX96589
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguguccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50818 - RNA, 1410 nt, Artificial Sequence; identical to SEQ ID NO: 47445
  neuraminidase__InfluenzaA__ADX96599

SEQ ID NO: 50819 - RNA, 1410 nt, Artificial Sequence
  neuraminidase__InfluenzaA__ADX96609
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcaggcaauuccucucucugcccuguugguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcgaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50820 - RNA, 1410 nt, Artificial Sequence; identical to SEQ ID NO: 47253
  neuraminidase__InfluenzaA__ADX96619

SEQ ID NO: 50821 - RNA, 1410 nt, Artificial Sequence; identical to SEQ ID NO: 47242
  neuraminidase__InfluenzaA__ADX96629

SEQ ID NO: 50822 - RNA, 1410 nt, Artificial Sequence; identical to SEQ ID NO: 47306
  neuraminidase__InfluenzaA__ADX96639

SEQ ID NO: 50823 - RNA, 1410 nt, Artificial Sequence; identical to SEQ ID NO: 50304
  neuraminidase__InfluenzaA__ADX96649

SEQ ID NO: 50824 - RNA, 1410 nt, Artificial Sequence; identical to SEQ ID NO: 47241
  neuraminidase__InfluenzaA__ADX96659

SEQ ID NO: 50825 - RNA, 1410 nt, Artificial Sequence; identical to SEQ ID NO: 47242
  neuraminidase__InfluenzaA__ADX96669

SEQ ID NO: 50826 - RNA, 1410 nt, Artificial Sequence; identical to SEQ ID NO: 48264
  neuraminidase__InfluenzaA__ADX96679

SEQ ID NO: 50827 - RNA, 1410 nt, Artificial Sequence; identical to SEQ ID NO: 47439
  neuraminidase__InfluenzaA__ADX96689

SEQ ID NO: 50828 - RNA, 1410 nt, Artificial Sequence; identical to SEQ ID NO: 47242
  neuraminidase__InfluenzaA__ADX96699

SEQ ID NO: 50829 - RNA, 1410 nt, Artificial Sequence
  neuraminidase__InfluenzaA__ADX96709
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaauaaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugaugagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50830 - RNA, 1410 nt, Artificial Sequence
  neuraminidase__InfluenzaA__ADX96719
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuugcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagagcacagucuggacuagcgggagcagcauauccuuuugugguguaaacagugacacuguggguuggucuuggccagacggugcugaguugccauuuaccauugacaaguaa

SEQ ID NO: 50831 - RNA, 1410 nt, Artificial Sequence
  neuraminidase__InfluenzaA__ADX96729
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacuuauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccugcuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50832 - RNA, 1410 nt, Artificial Sequence
  neuraminidase__InfluenzaA__ADX96739
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaaaagugacacuguggguuggucuuggccagacggugcugaguugccauuuaccauugacaaguaa

SEQ ID NO: 50833 - RNA, 1410 nt, Artificial Sequence; identical to SEQ ID NO: 47242
  neuraminidase__InfluenzaA__ADX96749

SEQ ID NO: 50834 - RNA, 1410 nt, Artificial Sequence
  neuraminidase__InfluenzaA__ADX96759
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaaacaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50835 - RNA, 1410 nt, Artificial Sequence; identical to SEQ ID NO: 49699
  neuraminidase__InfluenzaA__ADX96769

SEQ ID NO: 50836 - RNA, 1410 nt, Artificial Sequence; identical to SEQ ID NO: 47306
  neuraminidase__InfluenzaA__ADX96779

SEQ ID NO: 50837 - RNA, 1410 nt, Artificial Sequence
  neuraminidase__InfluenzaA__ADX96789
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccuugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50838 - RNA, 1410 nt, Artificial Sequence; identical to SEQ ID NO: 47242
  neuraminidase__InfluenzaA__ADX96799

SEQ ID NO: 50839 - RNA, 1410 nt, Artificial Sequence
  neuraminidase__InfluenzaA__ADX96809
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccaugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuagauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50840 - RNA, 1410 nt, Artificial Sequence; identical to SEQ ID NO: 47445
  neuraminidase__InfluenzaA__ADX96819

SEQ ID NO: 50841 - RNA, 1410 nt, Artificial Sequence; identical to SEQ ID NO: 48465
  neuraminidase__InfluenzaA__ADX96829

SEQ ID NO: 50842 - RNA, 1410 nt, Artificial Sequence
  neuraminidase__InfluenzaA__ADX96839
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauucuucucucugcccuguuaguggaugggcuauauacaguaaagacaacaauguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagaguccgaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguuucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcggaaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50843 - RNA, 1410 nt, Artificial Sequence; identical to SEQ ID NO: 50812
  neuraminidase__InfluenzaA__ADX96849

SEQ ID NO: 50844 - RNA, 1410 nt, Artificial Sequence
  neuraminidase__InfluenzaA__ADX96859
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagaaucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50845 - RNA, 1410 nt, Artificial Sequence
  neuraminidase__InfluenzaA__ADX96869
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagugggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaggacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50846 - RNA, 1410 nt, Artificial Sequence; identical to SEQ ID NO: 50795
  neuraminidase__InfluenzaA__ADX96879

SEQ ID NO: 50847 - RNA, 1410 nt, Artificial Sequence; identical to SEQ ID NO: 50802
  neuraminidase__InfluenzaA__ADX96899

SEQ ID NO: 50848 - RNA, 1410 nt, Artificial Sequence
  neuraminidase__InfluenzaA__ADX96909
augaauccaaaccaaaagauaauaaccauugguucggucuguaugacaauuggaauggcuaacuugauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacgauauauugagaacacaagagucugaaugugcauguguaaaugguucuugcuuuacuguaaugaccgauggaccaagugauggacaggccucauacaagaucuucagaauagaaaagggaaagauagucaaaucagucgaaauaaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaauucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50849 - RNA, 1410 nt, Artificial Sequence
  neuraminidase__InfluenzaA__ADX96919
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 50850 - RNA, 1410 nt, Artificial Sequence; identical to SEQ ID NO: 50849
  neuraminidase__InfluenzaA__ADX96929

SEQ ID NO: 50851 - RNA, 1410 nt, Artificial Sequence; identical to SEQ ID NO: 47707
  neuraminidase__InfluenzaA__ADX96939

SEQ ID NO: 50852 - RNA, 1410 nt, Artificial Sequence
  neuraminidase__InfluenzaA__ADX96949
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgaugggccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50853 - RNA, 1410 nt, Artificial Sequence
  neuraminidase__InfluenzaA__ADX96959
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugacugaugggccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50854 - RNA, 1410 nt, Artificial Sequence
  neuraminidase__InfluenzaA__ADX96969
augaauccaaaccaaaugauaauaaccauugguucggucuguaugacaauuggaauggccaacuuaauauuacaaauuggaaacauaaucucaauauggauuagccacucaauucaacuugggaaucaaaaccagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccaugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuagauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50855 - RNA, 1410 nt, Artificial Sequence; identical to SEQ ID NO: 48465
  neuraminidase__InfluenzaA__ADX96979

SEQ ID NO: 50856 - RNA, 1410 nt, Artificial Sequence; identical to SEQ ID NO: 48465
  neuraminidase__InfluenzaA__ADX96989

SEQ ID NO: 50857 - RNA, 1407 nt, Artificial Sequence
  neuraminidase__InfluenzaA__ADX96999
augaauccaaaccaaaagauaauaaccauugguucggucuguaugacaauuggaauggcuaacuuaauauuacaaauuggcauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50858 - RNA, 1410 nt, Artificial Sequence; identical to SEQ ID NO: 50795
  neuraminidase__InfluenzaA__ADX97009

SEQ ID NO: 50859 - RNA, 1410 nt, Artificial Sequence; identical to SEQ ID NO: 47397
  neuraminidase__InfluenzaA__ADX97020

SEQ ID NO: 50860 - RNA, 1410 nt, Artificial Sequence
  neuraminidase__InfluenzaA__ADX97030
augaauccaaaccaaaagauaauaaccauugguucggucuguaugauaauuggaauggcuaacuuaauguuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcaggcaauucuucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguuucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50861 - RNA, 1410 nt, Artificial Sequence; identical to SEQ ID NO: 48790
  neuraminidase__InfluenzaA__ADX98643

SEQ ID NO: 50862 - RNA, 1410 nt, Artificial Sequence
  neuraminidase__InfluenzaA__ADX98653
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaauaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50863 - RNA, 1410 nt, Artificial Sequence
  neuraminidase__InfluenzaA__ADX98668
augaauccaaaccaaaagauaauaaccauugguucgaucuguauuacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggaucuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50864 - RNA, 1410 nt, Artificial Sequence
  neuraminidase__InfluenzaA__ADX98678
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacgcaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50865 - RNA, 1410 nt, Artificial Sequence
  neuraminidase__InfluenzaA__ADX98698
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacagcaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50866 - RNA, 1410 nt, Artificial Sequence
  neuraminidase__InfluenzaA__ADX98708
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuauuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuucacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucaacauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 50867 - RNA, 1410 nt, Artificial Sequence; identical to SEQ ID NO: 47242
  neuraminidase__InfluenzaA__ADX98722

SEQ ID NO: 50868 - RNA, 1410 nt, Artificial Sequence; identical to SEQ ID NO: 47242
  neuraminidase__InfluenzaA__ADX98732

SEQ ID NO: 50869 - RNA, 1410 nt, Artificial Sequence
  neuraminidase__InfluenzaA__ADX98742
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuucacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagugggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 50870 - RNA, 1410 nt, Artificial Sequence; identical to SEQ ID NO: 49201
  neuraminidase__InfluenzaA__ADX98751

SEQ ID NO: 50871 - RNA, 1410 nt, Artificial Sequence; identical to SEQ ID NO: 48796
  neuraminidase__InfluenzaA__ADX98761

SEQ ID NO: 50872 - RNA, 1410 nt, Artificial Sequence
  neuraminidase__InfluenzaA__ADX98770
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuuacuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggggucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucaacauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50873 - RNA, 1410 nt, Artificial Sequence
  neuraminidase__InfluenzaA__ADX98780
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcugggcagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauuuccuuuugugguguaaacagugacacuguggguuggucuuggccagacggugcugaguugccauuuaccauugacaaguaa

SEQ ID NO: 50874 - RNA, 1410 nt, Artificial Sequence
  neuraminidase__InfluenzaA__ADX98788
augaauccaaaccaaaagauaauaaccauugguucggucuguaugacaauuggaauggcuaacuuaguauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucggcuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucggccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaaauucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50875 - RNA, 1410 nt, Artificial Sequence
  neuraminidase__InfluenzaA__ADX98809
augaauccaaaccaaaagauaauaaccauugguucggucuguaugacaauuggaauggcuaacuuaauauuacaaauuggaaacauaaucuuaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucuuugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50876 - RNA, 1410 nt, Artificial Sequence; identical to SEQ ID NO: 49857
  neuraminidase__InfluenzaA__ADX98821

SEQ ID NO: 50877 - RNA, 1410 nt, Artificial Sequence; identical to SEQ ID NO: 47242
  neuraminidase__InfluenzaA__ADX98846

SEQ ID NO: 50878 - RNA, 1410 nt, Artificial Sequence
  neuraminidase__InfluenzaA__ADX98856
augaauccaaaccaaaagauaaugaccauugguucggucuguaugacaauuggaauggcuaacuuaauauuacaaauuggaaacauaaucucaauauggauuagccacucaauucaacuugggauucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50879 - RNA, 1410 nt, Artificial Sequence
  neuraminidase__InfluenzaA__ADX98863
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagauaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50880 - RNA, 1410 nt, Artificial Sequence; identical to SEQ ID NO: 47242
  neuraminidase__InfluenzaA__ADX98873

SEQ ID NO: 50881 - RNA, 1410 nt, Artificial Sequence
  neuraminidase__InfluenzaA__ADX98883
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacguugcugcuggacagucagugguuuccgugaaauuagcgggcaauuccucucucugcccuguuaguggaugggcuauauacaguaaagacaacaguauaagaaucgguuccaagggggaugcguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaagcgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50882 - RNA, 1410 nt, Artificial Sequence; identical to SEQ ID NO: 47242
  neuraminidase__InfluenzaA__ADX98893

SEQ ID NO: 50883 - RNA, 1410 nt, Artificial Sequence; identical to SEQ ID NO: 47242
  neuraminidase__InfluenzaA__ADX98903

SEQ ID NO: 50884 - RNA, 1410 nt, Artificial Sequence; identical to SEQ ID NO: 48795
  neuraminidase__InfluenzaA__ADX98913

SEQ ID NO: 50885 - RNA, 1410 nt, Artificial Sequence; identical to SEQ ID NO: 49981
  neuraminidase__InfluenzaA__ADX98923

SEQ ID NO: 50886 - RNA, 1410 nt, Artificial Sequence; identical to SEQ ID NO: 48679
  neuraminidase__InfluenzaA__ADX98933

SEQ ID NO: 50887 - RNA, 1410 nt, Artificial Sequence; identical to SEQ ID NO: 47242
  neuraminidase__InfluenzaA__ADX98943

SEQ ID NO: 50888 - RNA, 1410 nt, Artificial Sequence
  neuraminidase__InfluenzaA__ADX98953
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauauaagaucuucagaauagaaaagggaaagauagucaaaucagucgaaaugaaugccccuaauuaucacuaugaggaaugcuccuguuauccugauucuaguaaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccaugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50889 - RNA, 1410 nt, Artificial Sequence; identical to SEQ ID NO: 47707
  neuraminidase__InfluenzaA__ADX98963

SEQ ID NO: 50890 - RNA, 1410 nt, Artificial Sequence
  neuraminidase__InfluenzaA__ADX98973
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugaucuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50891 - RNA, 1410 nt, Artificial Sequence
  neuraminidase__InfluenzaA__ADX98983
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaaaggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggaggaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccaaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50892 - RNA, 1410 nt, Artificial Sequence; identical to SEQ ID NO: 48286
  neuraminidase__InfluenzaA__ADX98993

SEQ ID NO: 50893 - RNA, 1410 nt, Artificial Sequence; identical to SEQ ID NO: 48286
  neuraminidase__InfluenzaA__ADX99003

SEQ ID NO: 50894 - RNA, 1365 nt, Artificial Sequence
  neuraminidase__InfluenzaA__ADX99584
augaauccaaaucagaaaauaacaaccauuggaucaaucugucugguagucggacuaauuagccuaauauugcaaauagggaauauaaucucaauauggauuagccauucaauucaaacuggaagucaaaaccauacuggaauaugcaaccaaaacaucauuaccuauaaaaauagcaccuggguaaaggacacaacuucagugauauuaaccggcaauucaucucuuugucccauccgugggugggcuauauacagcaaagacaauagcauaagaauugguuccaaaggagacguuuuugucauaagagagcccuuuauuucauguucucacuuggaaugcaggaccuuuuuucugacccaaggugccuuacugaaugacaagcauucaaaugggacuguuaaggacagaagcccuuauagggccuuaaugagcugcccugucggugaagcuccguccccguacaauucaagauuugaaucgguugcuuggucagcaagugcaugucaugauggcaugggcuggcuaacaaucggaauuucagguccagauaauggagcaguggcuguauuaaaauacaacggcauaauaacugaaaccauaaaaaguuggaggaagaaaauauugaggacacaagagucugaaugugccuguguaaaugguucauguuuuacuauaaugacugauggcccgagugaugggcuggccucguacaaaauuuucaagaucgaaaaggggaagguuacuaaaucaauagaguugaaugcaccuaauucucacuaugaggaauguuccuguuacccugauaccggcaaagugaugugugugugcagagacaacuggcaugguucgaaccggccaugggugucuuucgaucaaaaccuggauuaucaaauaggauacaucugcagugggguuuucggugacaacccgcgucccgaagauggaacaggcagcugugguccaguguauguugauggagcaaacggaguaaagggauuuucauauagguaugguaaugguguuuggauaggaaggaccaaaagucacaguuccagacauggguuugagaugauuugggauccuaauggauggacagagacugauaguaaguucucuguuaggcaagauguuguggcaaugacugauuggucaggguauagcggaaguuucguucaacauccugagcuaacagggcuagacuguaugaggccgugcuucuggguugaauuaaucaggggacgaccuaaagaaaaaacaaucuggacuagugcgagcagcauuucuuuuuguggcgugaauagugauacuguagauuggucuuggccagacggugcugaguugccauucagcauugacaaguag

SEQ ID NO: 50895 - RNA, 1365 nt, Artificial Sequence; identical to SEQ ID NO: 50894
  neuraminidase__InfluenzaA__ADX99595

SEQ ID NO: 50896 - RNA, 1365 nt, Artificial Sequence; identical to SEQ ID NO: 50894
  neuraminidase__InfluenzaA__ADX99606

SEQ ID NO: 50897 - RNA, 1365 nt, Artificial Sequence; identical to SEQ ID NO: 50894
  neuraminidase__InfluenzaA__ADX99617

SEQ ID NO: 50898 - RNA, 1365 nt, Artificial Sequence; identical to SEQ ID NO: 50894
  neuraminidase__InfluenzaA__ADX99628

SEQ ID NO: 50899 - RNA, 1365 nt, Artificial Sequence; identical to SEQ ID NO: 50894
  neuraminidase__InfluenzaA__ADX99639

SEQ ID NO: 50900 - RNA, 1365 nt, Artificial Sequence; identical to SEQ ID NO: 46223
  neuraminidase__InfluenzaA__ADX99650

SEQ ID NO: 50901 - RNA, 1365 nt, Artificial Sequence; identical to SEQ ID NO: 46223
  neuraminidase__InfluenzaA__ADX99672

SEQ ID NO: 50902 - RNA, 1365 nt, Artificial Sequence; identical to SEQ ID NO: 46223
  neuraminidase__InfluenzaA__ADX99683

SEQ ID NO: 50903 - RNA, 1365 nt, Artificial Sequence; identical to SEQ ID NO: 46223
  neuraminidase__InfluenzaA__ADX99694

SEQ ID NO: 50904 - RNA, 1365 nt, Artificial Sequence; identical to SEQ ID NO: 46223
  neuraminidase__InfluenzaA__ADX99705

SEQ ID NO: 50905 - RNA, 1365 nt, Artificial Sequence; identical to SEQ ID NO: 46223
  neuraminidase__InfluenzaA__ADX99846

SEQ ID NO: 50906 - RNA, 1365 nt, Artificial Sequence; identical to SEQ ID NO: 46223
  neuraminidase__InfluenzaA__ADX99857

SEQ ID NO: 50907 - RNA, 1365 nt, Artificial Sequence; identical to SEQ ID NO: 46223
  neuraminidase__InfluenzaA__ADX99868

SEQ ID NO: 50908 - RNA, 1365 nt, Artificial Sequence; identical to SEQ ID NO: 46223
  neuraminidase__InfluenzaA__ADX99879

SEQ ID NO: 50909 - RNA, 1365 nt, Artificial Sequence; identical to SEQ ID NO: 46223
  neuraminidase__InfluenzaA__ADX99890

SEQ ID NO: 50910 - RNA, 1365 nt, Artificial Sequence; identical to SEQ ID NO: 46223
  neuraminidase__InfluenzaA__ADX99901

SEQ ID NO: 50911 - RNA, 1365 nt, Artificial Sequence
  neuraminidase__InfluenzaA__ADX99912
augaauccaaaucagaaaauaauaaccauuggaucaaucugucugguagucggacuaauuagccuaauauugcaaauagggaauauaaucucaauauggauuagccauucaauucaaacuggaagucaaaaccauacuggaauaugcaaccaaaacaucauuaccuauaaaaauagcaccuggguaaaggacacaacuucagugauauuaaccggcaauucaucucuuugucccauccgugggugggcuauauacagcaaagacaauagcauaagaauugguuccaaaggagacguuuuuaucauaagagagcccuuuauuucauguucucacuuggaaugcaggaccuuuuuucugacccaaggugccuuacugaaugacaagcauucaagugggacuguuaaggacagaagcccuuauagggccuuaaugagcugcccugucggugaagcuccguccccguacaauucaagauuugaaucgguugcuuggucagcaagugcaugucaugauggcaugggcuggcuaacaaucggaauuucagguccagauaauggagcaguggcuguauuaaaauacaacggcauaauaacugaaaccauaaaaaguuggaggaagaaaauauugaggacacaagagucugaaugugccuguguaaaugguucauguuuuacuauaaugacugauggcccgagugaugggcuggccucguacaaaauuuucaagaucgaaaaggggaagguuacuaaaucaauagaguugaaugcaccuaauucucacuaugaggaauguuccuguuacccugauaccggcaaagugaugugugugugcagagacaauuggcaugguucgaaccggccaugggugucuuucgaucaaaaccuggauuaucaaauaggauacaucugcagugggguuuucggugacaacccgcgucccgaagauggaacaggcagcugugguccaguguauguugauggagcaaacggaguaaagggauuuucauauagguaugguaaugguguuuggauaggaaggaccaaaagucacaguuccagacauggguuugagaugauuugggauccuaauggauggacagagacugauaguaaguucucugugaggcaagauguuguggcaaugacugauuggucaggguauagcggaaguuucguucaacauccugagcugacagggcuagacuguaugaggccgugcuucuggguugaauuaaucaggggacgaccuaaagaaaaaacaaucuggacuagugcgagcagcauuucuuuuuguggcgugaauagugauacuguagauuggucuuggccagacggugcugaguugccauucagcauugacaaguag

SEQ ID NO: 50912 - RNA, 1365 nt, Artificial Sequence; identical to SEQ ID NO: 46223
  neuraminidase__InfluenzaA__ADX99923

SEQ ID NO: 50913 - RNA, 1365 nt, Artificial Sequence; identical to SEQ ID NO: 46223
  neuraminidase__InfluenzaA__ADX99934

SEQ ID NO: 50914 - RNA, 1365 nt, Artificial Sequence; identical to SEQ ID NO: 46223
  neuraminidase__InfluenzaA__ADX99956

SEQ ID NO: 50915 - RNA, 1365 nt, Artificial Sequence; identical to SEQ ID NO: 46223
  neuraminidase__InfluenzaA__ADX99967

SEQ ID NO: 50916 - RNA, 1365 nt, Artificial Sequence; identical to SEQ ID NO: 46223
  neuraminidase__InfluenzaA__ADX99978

SEQ ID NO: 50917 - RNA, 1365 nt, Artificial Sequence; identical to SEQ ID NO: 46223
  neuraminidase__InfluenzaA__ADX99989

SEQ ID NO: 50918 - RNA, 1365 nt, Artificial Sequence; identical to SEQ ID NO: 46223
  neuraminidase__InfluenzaA__ADY00001

SEQ ID NO: 50919 - RNA, 1365 nt, Artificial Sequence; identical to SEQ ID NO: 46223
  neuraminidase__InfluenzaA__ADY00012

SEQ ID NO: 50920 - RNA, 1365 nt, Artificial Sequence; identical to SEQ ID NO: 46223
  neuraminidase__InfluenzaA__ADY00023

SEQ ID NO: 50921 - RNA, 1413 nt, Artificial Sequence
  neuraminidase__InfluenzaA__ADY04729
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacaauggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagccccuauagggcuuuaaugagcuguccucuaggugaagcuccauccccauacaauucaaaguuugaaucaguugcuuggucggcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaggagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucuggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguaa

SEQ ID NO: 50922 - RNA, 1410 nt, Artificial Sequence
  neuraminidase__InfluenzaA__ADY11828
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcaagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 50923 - RNA, 1410 nt, Artificial Sequence; identical to SEQ ID NO: 48087
  neuraminidase__InfluenzaA__ADY11839

SEQ ID NO: 50924 - RNA, 1410 nt, Artificial Sequence; identical to SEQ ID NO: 48087
  neuraminidase__InfluenzaA__ADY17657

SEQ ID NO: 50925 - RNA, 1410 nt, Artificial Sequence; identical to SEQ ID NO: 48087
  neuraminidase__InfluenzaA__ADY17668

SEQ ID NO: 50926 - RNA, 1410 nt, Artificial Sequence; identical to SEQ ID NO: 48087
  neuraminidase__InfluenzaA__ADY17679

SEQ ID NO: 50927 - RNA, 1410 nt, Artificial Sequence; identical to SEQ ID NO: 48087
  neuraminidase__InfluenzaA__ADY17690

SEQ ID NO: 50928 - RNA, 1410 nt, Artificial Sequence; identical to SEQ ID NO: 48087
  neuraminidase__InfluenzaA__ADY17701

SEQ ID NO: 50929 - RNA, 1410 nt, Artificial Sequence; identical to SEQ ID NO: 47441
  neuraminidase__InfluenzaA__ADY38722

SEQ ID NO: 50930 - RNA, 1410 nt, Artificial Sequence; identical to SEQ ID NO: 48991
  neuraminidase__InfluenzaA__ADY38723

SEQ ID NO: 50931 - RNA, 1410 nt, Artificial Sequence; identical to SEQ ID NO: 47689
  neuraminidase__InfluenzaA__ADY38734

SEQ ID NO: 50932 - RNA, 1410 nt, Artificial Sequence
  neuraminidase__InfluenzaA__ADY38753
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagagaaccauucauaucaugcucccccuuggaaugcagaaccuucuucuugacucaaggggccuugcuaaaugacaaacauuccaauggaaccauuaaagacaggagcucauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50933 - RNA, 1410 nt, Artificial Sequence; identical to SEQ ID NO: 48286
  neuraminidase__InfluenzaA__ADY38763

SEQ ID NO: 50934 - RNA, 1410 nt, Artificial Sequence; identical to SEQ ID NO: 47242
  neuraminidase__InfluenzaA__ADZ04600

SEQ ID NO: 50935 - RNA, 1410 nt, Artificial Sequence; identical to SEQ ID NO: 47242
  neuraminidase__InfluenzaA__ADZ04610

SEQ ID NO: 50936 - RNA, 1410 nt, Artificial Sequence; identical to SEQ ID NO: 47242
  neuraminidase__InfluenzaA__ADZ04693

SEQ ID NO: 50937 - RNA, 1410 nt, Artificial Sequence; identical to SEQ ID NO: 47242
  neuraminidase__InfluenzaA__ADZ04701

SEQ ID NO: 50938 - RNA, 1410 nt, Artificial Sequence; identical to SEQ ID NO: 47242
  neuraminidase__InfluenzaA__ADZ04711

SEQ ID NO: 50939 - RNA, 1410 nt, Artificial Sequence
  neuraminidase__InfluenzaA__ADZ05393
augaauccaaaccaaaagauaauaaccauugauucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuuuagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50940 - RNA, 1413 nt, Artificial Sequence
  neuraminidase__InfluenzaA__ADZ05837
augaacccaaaucaaaagauaauaaccauuggaucaaucaguauagcaaucggaauaauuagucuaauguuacaaauaggaaauauuauuucaauaugggcuagucacucaauccaaacuggaagucaaaacaacacuggaauaugcaaccaaagaaucaucacaugugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuugaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacugggaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggacccuaauggauggacaaauaccgacagugauuucucagugaaacaggauguuguagcaacaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 50941 - RNA, 1413 nt, Artificial Sequence; identical to SEQ ID NO: 49437
  neuraminidase__InfluenzaA__ADZ05848

SEQ ID NO: 50942 - RNA, 1410 nt, Artificial Sequence; identical to SEQ ID NO: 49436
  neuraminidase__InfluenzaA__ADZ05858

SEQ ID NO: 50943 - RNA, 1410 nt, Artificial Sequence; identical to SEQ ID NO: 47306
  neuraminidase__InfluenzaA__ADZ47841

SEQ ID NO: 50944 - RNA, 1410 nt, Artificial Sequence; identical to SEQ ID NO: 47242
  neuraminidase__InfluenzaA__ADZ47851

SEQ ID NO: 50945 - RNA, 1410 nt, Artificial Sequence
  neuraminidase__InfluenzaA__ADZ47861
augaauccaaaccaaaagauaauaaccauugguucggucuguaugacaauuggauuggcuaacuuaauauuacaaauuggaaacauaaucucaauauggauuagccacucaauucaacuuggaaaucaaaaucagauugaaacaugcaaucaaagcgucauuacuuaugaaaacaacacuuggguaaaucagacauauguuaacaucagcaacaucaacuuugcugcuggacagucagugguuuccgugaaauuagcgggcaauuccucucucugcccuguuaguggaugggcuauauacaguaaagacaacaguguaagaauugguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucggauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaaaaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50946 - RNA, 1413 nt, Artificial Sequence
  neuraminidase__InfluenzaA__ADZ53101
augaacccaaaucaaaagauaauaaccauuggaucaaucaguauagcaaucgggauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaaaguuguugcuggagaggacaaaacuucagugacauuggccggcaauucaucucuuuguucuaucaguggaugggcuauaaacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuuuaccauaaugaccgauggcccgaguaauaaggccgccucguacaaaauuuucaagaucgaaaaagggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugggguuuggauaggaaggaccaaaaguaacagacuuagaaagggguuugagaugauuugggauccuaauggauggacaaauaccgacagugauuucucagugaaacaggauguuguagcaauaacugauuggucaggauacagcgggaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 50947 - RNA, 1410 nt, Artificial Sequence
  neuraminidase__InfluenzaA__ADZ53124
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaaugacuucucaauaaagcaagauaucguaggaauaaaugaguggucaggauauagcgggaguuuuguucagcauccagaacuaacagggcuggauuguauaagaccuugcuucuggguugaauuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50948 - RNA, 1410 nt, Artificial Sequence; identical to SEQ ID NO: 47242
  neuraminidase__InfluenzaA__ADZ53130

SEQ ID NO: 50949 - RNA, 1410 nt, Artificial Sequence; identical to SEQ ID NO: 47241
  neuraminidase__InfluenzaA__ADZ53132

SEQ ID NO: 50950 - RNA, 1410 nt, Artificial Sequence; identical to SEQ ID NO: 47242
  neuraminidase__InfluenzaA__ADZ53134

SEQ ID NO: 50951 - RNA, 1410 nt, Artificial Sequence; identical to SEQ ID NO: 47242
  neuraminidase__InfluenzaA__ADZ53136

SEQ ID NO: 50952 - RNA, 1410 nt, Artificial Sequence
  neuraminidase__InfluenzaA__ADZ53137
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50953 - RNA, 1410 nt, Artificial Sequence; identical to SEQ ID NO: 47242
  neuraminidase__InfluenzaA__ADZ53139

SEQ ID NO: 50954 - RNA, 1410 nt, Artificial Sequence
  neuraminidase__InfluenzaA__ADZ53141
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaaugacuucucaauaaagcaagauaucguaggaauaaaugaguggucaggauauagcgggaguuuuguucagcauucagaacuaacagggcuggauuguauaagaccuugcuucuggguugaauuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 50955 - RNA, 1410 nt, Artificial Sequence; identical to SEQ ID NO: 49717
  neuraminidase__InfluenzaA__AEA03712

SEQ ID NO: 50956 - RNA, 1410 nt, Artificial Sequence; identical to SEQ ID NO: 47103
  neuraminidase__InfluenzaA__AEA03722

SEQ ID NO: 50957 - RNA, 1410 nt, Artificial Sequence
  neuraminidase__InfluenzaA__AEA03744
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaaggcggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50958 - RNA, 1410 nt, Artificial Sequence
  neuraminidase__InfluenzaA__AEA03755
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugguaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucaucuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaaguugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50959 - RNA, 1410 nt, Artificial Sequence
  neuraminidase__InfluenzaA__AEA03766
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagacaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggaucccaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50960 - RNA, 1410 nt, Artificial Sequence; identical to SEQ ID NO: 49717
  neuraminidase__InfluenzaA__AEA03796

SEQ ID NO: 50961 - RNA, 1410 nt, Artificial Sequence; identical to SEQ ID NO: 47103
  neuraminidase__InfluenzaA__AEA03806

SEQ ID NO: 50962 - RNA, 1410 nt, Artificial Sequence
  neuraminidase__InfluenzaA__AEA03817
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacagguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuaugugugcucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50963 - RNA, 1410 nt, Artificial Sequence; identical to SEQ ID NO: 49717
  neuraminidase__InfluenzaA__AEA03828

SEQ ID NO: 50964 - RNA, 1410 nt, Artificial Sequence; identical to SEQ ID NO: 49717
  neuraminidase__InfluenzaA__AEA03838

SEQ ID NO: 50965 - RNA, 1410 nt, Artificial Sequence
  neuraminidase__InfluenzaA__AEA03849
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaaggacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaugucuuguggaccucaaacaguauuguuguguuuuguggcaccucagguacauauggaacaggcucauggccugauggggcggacaucaaucucaugccuauauaa

SEQ ID NO: 50966 - RNA, 1410 nt, Artificial Sequence; identical to SEQ ID NO: 47103
  neuraminidase__InfluenzaA__AEA03860

SEQ ID NO: 50967 - RNA, 1410 nt, Artificial Sequence
  neuraminidase__InfluenzaA__AEA03871
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcugaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaauaacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50968 - RNA, 1410 nt, Artificial Sequence; identical to SEQ ID NO: 49717
  neuraminidase__InfluenzaA__AEA03879

SEQ ID NO: 50969 - RNA, 1410 nt, Artificial Sequence
  neuraminidase__InfluenzaA__AEA03889
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcugaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacaaaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50970 - RNA, 1410 nt, Artificial Sequence
  neuraminidase__InfluenzaA__AEA03898
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaagcgacagcuccagcaguagccauuguuuggauccuaacaaugaagaaggcggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50971 - RNA, 1410 nt, Artificial Sequence
  neuraminidase__InfluenzaA__AEA03909
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcugaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcacgucagguacauauggaacaggcucauggccugauggggcggacaucaaucucaugccuauauaa

SEQ ID NO: 50972 - RNA, 1410 nt, Artificial Sequence
  neuraminidase__InfluenzaA__AEA03924
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcugaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucauucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggcauuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50973 - RNA, 1410 nt, Artificial Sequence; identical to SEQ ID NO: 47755
  neuraminidase__InfluenzaA__AEA03935

SEQ ID NO: 50974 - RNA, 1410 nt, Artificial Sequence
  neuraminidase__InfluenzaA__AEA03946
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccgaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucaacaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50975 - RNA, 1410 nt, Artificial Sequence
  neuraminidase__InfluenzaA__AEA03957
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcugaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugauguguggaugggaagaacgaucagcgagaagucacgcuuaggguaugaaaccuucaaagucauugaaggcugguccaacucuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50976 - RNA, 1410 nt, Artificial Sequence
  neuraminidase__InfluenzaA__AEA03989
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucaucuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaaguugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50977 - RNA, 1410 nt, Artificial Sequence; identical to SEQ ID NO: 50965
  neuraminidase__InfluenzaA__AEA04000

SEQ ID NO: 50978 - RNA, 1410 nt, Artificial Sequence; identical to SEQ ID NO: 50957
  neuraminidase__InfluenzaA__AEA04011

SEQ ID NO: 50979 - RNA, 1410 nt, Artificial Sequence; identical to SEQ ID NO: 50965
  neuraminidase__InfluenzaA__AEA04022

SEQ ID NO: 50980 - RNA, 1410 nt, Artificial Sequence; identical to SEQ ID NO: 50957
  neuraminidase__InfluenzaA__AEA04033

SEQ ID NO: 50981 - RNA, 1410 nt, Artificial Sequence; identical to SEQ ID NO: 50957
  neuraminidase__InfluenzaA__AEA04044

SEQ ID NO: 50982 - RNA, 1410 nt, Artificial Sequence; identical to SEQ ID NO: 50957
  neuraminidase__InfluenzaA__AEA04049

SEQ ID NO: 50983 - RNA, 1410 nt, Artificial Sequence; identical to SEQ ID NO: 50957
  neuraminidase__InfluenzaA__AEA04059

SEQ ID NO: 50984 - RNA, 1410 nt, Artificial Sequence
  neuraminidase__InfluenzaA__AEA04070
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaaggcggucauggagugaaaggcugggccuuugaugauggaaaugacguguggaugggaagaacgaucagcgagaagucacgcuuaggguaugaaaccuucaaagucauugaaggcugguccaacccaaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50985 - RNA, 1410 nt, Artificial Sequence
  neuraminidase__InfluenzaA__AEA04081
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaaggacgaucagcgagaagucacgcuuaggguaugaaaccuucaaagucauugaaggcugguccaacccaaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaugucuuguggaccucaaacaguauuguuguguuuuguggcaccucagguacauauggaacaggcucauggccugauggggcggacaucaaucucaugccuauauaa

SEQ ID NO: 50986 - RNA, 1410 nt, Artificial Sequence
  neuraminidase__InfluenzaA__AEA04092
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauucgcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50987 - RNA, 1410 nt, Artificial Sequence; identical to SEQ ID NO: 50984
  neuraminidase__InfluenzaA__AEA04103

SEQ ID NO: 50988 - RNA, 1410 nt, Artificial Sequence; identical to SEQ ID NO: 47755
  neuraminidase__InfluenzaA__AEA04125

SEQ ID NO: 50989 - RNA, 1410 nt, Artificial Sequence; identical to SEQ ID NO: 50976
  neuraminidase__InfluenzaA__AEA04133

SEQ ID NO: 50990 - RNA, 1410 nt, Artificial Sequence
  neuraminidase__InfluenzaA__AEA04144
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcugaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucauucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuauuguguuuuguggcaccucagguacauauggaacaggcucauggccugauggggcggacaucaaucucaugccuauauaa

SEQ ID NO: 50991 - RNA, 1410 nt, Artificial Sequence
  neuraminidase__InfluenzaA__AEA04155
augaauccaaaucaaaagauaauaacaauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcugaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagauaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50992 - RNA, 1410 nt, Artificial Sequence
  neuraminidase__InfluenzaA__AEA04166
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcugaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagauaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50993 - RNA, 1410 nt, Artificial Sequence
  neuraminidase__InfluenzaA__AEA04177
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacguaauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucaacaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50994 - RNA, 1410 nt, Artificial Sequence
  neuraminidase__InfluenzaA__AEA04188
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaacuagcugaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaauaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 50995 - RNA, 1410 nt, Artificial Sequence
  neuraminidase__InfluenzaA__AEA04199
augaauccaaaucaaaagauaauaacgauuggcucuguuucucucaccauuuccacaauaugcuucuucaugcaaaccgccauccugauaacuacuguaacauugcauuucaagcaaugugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacgcuaaacaacgugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaaggaaagaggaaacugaagucuuguggaccucaaacaguauuguuguguuuuguggcaccucagguacauauggaacaggcucauggccugauggggcggacaucaaucucaugccuauauaa

SEQ ID NO: 50996 - RNA, 1410 nt, Artificial Sequence; identical to SEQ ID NO: 49717
  neuraminidase__InfluenzaA__AEA04210

SEQ ID NO: 50997 - RNA, 1410 nt, Artificial Sequence
  neuraminidase__InfluenzaA__AEA04229
augaauccaaaucaaaagauaauaacgauuggcucuguuucucucaccauuuccacaauaugcuucuucaugcaaaccgccauccugauaacuacuguaacauugcauuucaagcaaugugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacgcuaaacaacgugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaaaucacgcuuaggguaugaaaccuucaaagucauugaaggcugguccaacccuaagucaaaauugcagauaaauaggcaagucauaguugacagagguaauagguccgguuauucugguauuuucucuguugaaggcaaaagcugcaucaaucggugcuuuuauguggaguugauaaggggaaggaaagaggaaacugaagucuuguggaccucaaacaguauuguuguguuuuguggcaccucagguacauauggaacaggcucauggccugauggggcggacaucaaucucaugccuauauaa

SEQ ID NO: 50998 - RNA, 1410 nt, Artificial Sequence; identical to SEQ ID NO: 50997
  neuraminidase__InfluenzaA__AEA04239

SEQ ID NO: 50999 - RNA, 1410 nt, Artificial Sequence
  neuraminidase__InfluenzaA__AEA04250
augaauccaaaucaaaagauaauaacgauuggcucuguuucucucaccauuuccacaauaugcuucuucaugcaaaccgccauccugauaacuacuguaacauugcauuucaagcaaugugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacguguuaggaccccuuaucggacucuauugaugaaugaguuagguguuccuuuucaucuggggaccaagcaagugugcauagcaugguccagcucaaguugucacgauggaaaagcauggcugcauguuuguauaacgggggaugacaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggaguaaaaggcugggccuuugaugauggaaaugacguguggaugggaagaacgaucagcgagaaaucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaaggaaagaggaaacugaagucuuguggaccucaaacaguauuguuguguuuuguggcaccucagguacauauggaacaggcucauggccugauggggcggacaucaaucucaugccuauauaa

SEQ ID NO: 51000 - RNA, 1410 nt, Artificial Sequence
  neuraminidase__InfluenzaA__AEA04260
augaauccaaaucaaaagauaauaacgauuggcucuguuucucucaccauuuccacaauaugcuucuucaugcaaaccgccauccugauaacuacuguaacauugcauuucaagcaaugugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacgcuaaacaacgugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaaaucacgcuuaggguaugaaaccuucaaagucauugaaggcugguccaacccuaagucaaaauugcagauaaauaggcaagucauaguugacagagguaauagguccgguuauucugguauuuucucuguugaaggcaaaagcugcaucaaucggugcuuuuauguggaguugauaaggggaaggaaagaggaaacugaagucuuguggaccucaaacaguauuguuguguuuuguggcaccucagguacauauggcacaggcucauggccugauggggcggacaucaaucucaugccuauauaa

SEQ ID NO: 51001 - RNA, 1410 nt, Artificial Sequence
  neuraminidase__InfluenzaA__AEA04268
augaauccaaaucaaaagauaauaacgauuggcucuguuucucucaccauuuccacaauaugccucuucaugcaaaccgccauccugauaacuacuguaacauugcauuucaagcaaugugaauucaacucccccccaaacaaccaagcgaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaaaucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaaggaaagaggaaacugaagucuuguggaccucaaacaguauuguuguguuuuguggcaccucagguacauauggaacaggcucauggccugauggggcggacaucaaucucaugccuauauaa

SEQ ID NO: 51002 - RNA, 1410 nt, Artificial Sequence; identical to SEQ ID NO: 50997
  neuraminidase__InfluenzaA__AEA04276

SEQ ID NO: 51003 - RNA, 1410 nt, Artificial Sequence; identical to SEQ ID NO: 50997
  neuraminidase__InfluenzaA__AEA04287

SEQ ID NO: 51004 - RNA, 1410 nt, Artificial Sequence; identical to SEQ ID NO: 50997
  neuraminidase__InfluenzaA__AEA04298

SEQ ID NO: 51005 - RNA, 1410 nt, Artificial Sequence
  neuraminidase__InfluenzaA__AEA04307
augaauccaaaucaaaagauaauaacgauuggcucuguuucucucaccauuuccacaauaugcuucuucaugcaaaccgccauccugauaacuacuguaacauugcauuucaagcaaugugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacgcuaaacaacgugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccugaugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaaaucacgcuuaggguaugaaaccuucaaagucauugaaggcugguccaacccuaagucaaaauugcagauaaauaggcaagucauaguugacagagguaauagguccgguuauucugguauuuucucuguugaaggcaaaagcugcaucaaucggugcuuuuauguggaguugauaaggggaaggaaagaggaaacugaagucuuguggaccucaaacaguauuguuguguuuuguggcaccucagguacauauggaacaggcucauggccugauggggcggacaucaaucucaugccuauauaa

SEQ ID NO: 51006 - RNA, 1395 nt, Artificial Sequence
  neuraminidase__InfluenzaA__AEA04357
augaauccaaaucagaaaauaauaaccauuggaucaaucuguaugguagucggaauaauuagccuaauauugcaaauagggaauauugucucaauauggauuagccauucaauucaaacuggaaaucaaaaccauacuggaacuugcgaccaaagcaucauuaccuauaaaaauagcaccuggguaaaucaaacauaugucaacguuguugcugggaaggauacaacuucagugauauuagccggcaauucaucucuuugcccuauccgugggugggcuauauacagcaaagauaauggcguaagaauugguuccaaaggagauguuuuugucauaagagaacccuuuauuucauguucucacuuggaaugcaggaccuuuuuucugacccaaggcgcccuguugaaugacaagcauucaaaugggaccguuaaggacagaagcccuuauagggccuuaaugagcugcccuguuggugaagcuccguccccguacaacucaagguuugaaucgguugcuuggucagcaagugcaugucaugauggcaugggcuggcuaacaaucggaauuucugguccagaugauggagcaguggcuguguuaaaauacaacggcauaauaacugaaaccauaaaaaguuggaggaaggaaauauugagaacacaagagucugaaugugucugcguaaaugguucauguuucacuauaaugaccgacggcccgaguggugggccggccucguacaaaauuuucaagaucgagaaggggaagguuacuaaaucaauagaguuggaugcaccuaauucucacuacgaggaauguuccuguuacccugauaccagcaaagugaugugugugugcagagacaauuggcacgguucgaaccgaccaugggugucuuucgaucaaaaucuggauuaucaaaugggauacaucugcagugggguuuucggugacaauccgcgucccaaagauggaaaaggcagcugugguccaguguauguugauggagcaaacggaguaaagggauuuucauacaaguaugguaaugguguuuggauagggaggacuaaaaguaucaguuccagacagggguucgagaugauuugggauccuaauggguggacagagacugauaguaauuucuuuacgaaacaagauguaguggcaguaaccgauuggucaggguacagcggaaguuucguucaacauccugagcuaacagggcuggacuguaugaggccuugcuucuggguugaauuaaucaggggacgaccuaaagaaaauacaaucuggaccagugggagcagcauuucuuuuuguggugugaauagugauacuguagauuggucuuggccagacggugccgaguugccauucaccauugacaaguag

SEQ ID NO: 51007 - RNA, 1410 nt, Artificial Sequence; identical to SEQ ID NO: 46971
  neuraminidase__InfluenzaA__AEA04368

SEQ ID NO: 51008 - RNA, 1410 nt, Artificial Sequence
  neuraminidase__InfluenzaA__AEA04379
augaauccaaaucaaaagacaauaacaauuggcucugucucucucaccauugaaacaguaugcuuccucaugcagauugccauccuggcaacuacugugacauugcauuuuaagcaacaugagugcgacucccccgcgagcaaccaaguaaugccaugugaaccaauaauaauagaaaggaacauaacagagauaguguauuugaauaacaccaccauagagaaagagauuugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaauggcacaauacaugauagaaucccucaucgaacccuauuaaugaaugaguuggguguuccauuucauuuaggaaccaaacaaguguguguagcaugguccagcucaaguugucacgauggaaaagcaugguugcauguuugugucacuggggaugauagaaaugcaacugcuagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaguguuccuguuacccucgauauccugacgucagauguaucugcagagacaacuggaaaggcucuaauaggcccguuauagacauaaauauggaagauuauagcauugauuccaguuaugugugcucagggcuuguuggcgacacacccaggaacgacgacagcucuagcaauagcaaaagcagggauccuaacaaugagagagggaauccaggagugaaaggcugggccuuugacaauggagaugauguauggaugggaagaacaaucagcaaagauucacgcucagguuaugaaacuuucaaagucauuggugguugguccacaccuaauuccaaaucgcaggucaauagacaggucauaguugacaacaauaauuggucugguuacucugguauuuucucuguugagggcaaaagcugcaucaauaggugcuuuuauguggaguugauaaggggaaggccacaggagacuagaguaugguggaccucaaacaguauuguuguguuuuguggcacuucagguacuuauggaacaggcucauggccugauggggcgaacaucaauuucaugccuauauaa

SEQ ID NO: 51009 - RNA, 1413 nt, Artificial Sequence; identical to SEQ ID NO: 50708
  neuraminidase__InfluenzaA__AEA10295

SEQ ID NO: 51010 - RNA, 1410 nt, Artificial Sequence; identical to SEQ ID NO: 49083
  neuraminidase__InfluenzaA__AEA10306

SEQ ID NO: 51011 - RNA, 1410 nt, Artificial Sequence
  neuraminidase__InfluenzaA__AEA10316
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcaucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagaaucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaagcgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51012 - RNA, 1410 nt, Artificial Sequence
  neuraminidase__InfluenzaA__AEA10326
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucaucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51013 - RNA, 1410 nt, Artificial Sequence
  neuraminidase__InfluenzaA__AEA10335
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucaguaacaccaacuuugcugcuggacagucagugguuuccgugaaguuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaacauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51014 - RNA, 1410 nt, Artificial Sequence
  neuraminidase__InfluenzaA__AEA10342
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcugucuuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 51015 - RNA, 1410 nt, Artificial Sequence
  neuraminidase__InfluenzaA__AEA10352
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguauaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguuguaguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51016 - RNA, 1410 nt, Artificial Sequence; identical to SEQ ID NO: 48286
  neuraminidase__InfluenzaA__AEA48991

SEQ ID NO: 51017 - RNA, 1410 nt, Artificial Sequence
  neuraminidase__InfluenzaA__AEA72707
augaauccaaaucaaaagauaauaacgauuggcucuguuucucucaccauuuccacaauaugcuucuucaugcaaauugccaucuugauaacuacuguaacauugcauuucaagcaauauaaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaaugugacauuacgggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcuugguccagcucgaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaauuguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagggggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51018 - RNA, 1410 nt, Artificial Sequence; identical to SEQ ID NO: 49914
  neuraminidase__InfluenzaA__AEA72718

SEQ ID NO: 51019 - RNA, 1410 nt, Artificial Sequence; identical to SEQ ID NO: 49914
  neuraminidase__InfluenzaA__AEA72729

SEQ ID NO: 51020 - RNA, 1410 nt, Artificial Sequence
  neuraminidase__InfluenzaA__AEA72742
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaaaggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51021 - RNA, 1410 nt, Artificial Sequence
  neuraminidase__InfluenzaA__AEA72779
augaauccaaaccaaaagauaauaaccauugguucggucuguaugacaauuggaauggcuaacuuaauauuacaaauugggaacauaaucucaauauggauuagccacucaauucaacuugggaauaaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaggauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51022 - RNA, 1410 nt, Artificial Sequence
  neuraminidase__InfluenzaA__AEA72789
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacgacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51023 - RNA, 1410 nt, Artificial Sequence; identical to SEQ ID NO: 49914
  neuraminidase__InfluenzaA__AEA73291

SEQ ID NO: 51024 - RNA, 1410 nt, Artificial Sequence; identical to SEQ ID NO: 49914
  neuraminidase__InfluenzaA__AEA73302

SEQ ID NO: 51025 - RNA, 1410 nt, Artificial Sequence; identical to SEQ ID NO: 49914
  neuraminidase__InfluenzaA__AEA73313

SEQ ID NO: 51026 - RNA, 1410 nt, Artificial Sequence; identical to SEQ ID NO: 49914
  neuraminidase__InfluenzaA__AEA73324

SEQ ID NO: 51027 - RNA, 1410 nt, Artificial Sequence
  neuraminidase__InfluenzaA__AEA73335
augaauccaaaucaaaagauaauaacgauuggcucuguuucucucaccauuuccacaauaugcuucuucaugcaaauugccaucuugauaacuacuguaacauugcauuucaagcaauauaaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaaugugacauuacgggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaaguaugcauagcaugguccagcucgaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaauuguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51028 - RNA, 1410 nt, Artificial Sequence; identical to SEQ ID NO: 49914
  neuraminidase__InfluenzaA__AEA73346

SEQ ID NO: 51029 - RNA, 1410 nt, Artificial Sequence; identical to SEQ ID NO: 49914
  neuraminidase__InfluenzaA__AEA73357

SEQ ID NO: 51030 - RNA, 1410 nt, Artificial Sequence; identical to SEQ ID NO: 49914
  neuraminidase__InfluenzaA__AEA73368

SEQ ID NO: 51031 - RNA, 1410 nt, Artificial Sequence; identical to SEQ ID NO: 49914
  neuraminidase__InfluenzaA__AEA73379

SEQ ID NO: 51032 - RNA, 1410 nt, Artificial Sequence; identical to SEQ ID NO: 49914
  neuraminidase__InfluenzaA__AEA73390

SEQ ID NO: 51033 - RNA, 1410 nt, Artificial Sequence; identical to SEQ ID NO: 49914
  neuraminidase__InfluenzaA__AEA73401

SEQ ID NO: 51034 - RNA, 1410 nt, Artificial Sequence; identical to SEQ ID NO: 49914
  neuraminidase__InfluenzaA__AEA73412

SEQ ID NO: 51035 - RNA, 1410 nt, Artificial Sequence; identical to SEQ ID NO: 49914
  neuraminidase__InfluenzaA__AEA73423

SEQ ID NO: 51036 - RNA, 1410 nt, Artificial Sequence; identical to SEQ ID NO: 49914
  neuraminidase__InfluenzaA__AEA73455

SEQ ID NO: 51037 - RNA, 1410 nt, Artificial Sequence; identical to SEQ ID NO: 49914
  neuraminidase__InfluenzaA__AEA73466

SEQ ID NO: 51038 - RNA, 1410 nt, Artificial Sequence
  neuraminidase__InfluenzaA__AEA73477
augaauccaaaucaaaagauaauaacgauuggcucuguuucucucaccauuuccacaauaugcuucuucaugcaaauugccaucuugauaacuacuguaacauugcauuucaagcaauauaaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaaugugacauuacgggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucgaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaauuguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacuaaagucuuguggaccucaaacaguauuguuguguuuuguggcaccucagguacauauggaacaggcucauggccugauggggcggaccucaaucucaugccuauauaa

SEQ ID NO: 51039 - RNA, 1410 nt, Artificial Sequence
  neuraminidase__InfluenzaA__AEA73488
augaauccaaaucaaaagauaauaacgauuggcucuguuucucucaccauuuccacaauaugcuucuucaugcaaauugccaucuugauaacuacuguaacauugcauuucaagcaauauaaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaaugugacauuacgggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcuugguccagcucgaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaauuguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51040 - RNA, 1410 nt, Artificial Sequence
  neuraminidase__InfluenzaA__AEA73499
augaauccaaaucaaaagauaauaacgauuggcucuguuucucucaccauuuccacaauaugcuucuucaugcaaauugccaucuugauaacuacuguaacauugcauuucaagcaauauaaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaaugugacauuacgggauuugcaccuuuuucuaaggacaauucgauuaggcuuuccgcugguggggacaucugggugacaagagaaccuuaugugucaugcgauccugacaaguguuaucaauuugcccuuggacagggaacaacaauaaacaacgugcauucaaauaacacaguacgugauaggaccccuuaucggacccuauugaugaaugaguuagguguuccuuuucaucuggggaccaagcaagugugcauagcaugguccagcucgaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaauuguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51041 - RNA, 1410 nt, Artificial Sequence
  neuraminidase__InfluenzaA__AEA73510
augaauccaaaucaaaagauaauaacgauuggcucuguuucucucaccauuuccacaauaugcuucuucaugcaaauugccaucuugauaacuacuguaacauugcauuucaagcaauauaaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaaugugacauuacgggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucgaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaauuguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccagcuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51042 - RNA, 1410 nt, Artificial Sequence; identical to SEQ ID NO: 49914
  neuraminidase__InfluenzaA__AEA73521

SEQ ID NO: 51043 - RNA, 1410 nt, Artificial Sequence
  neuraminidase__InfluenzaA__AEA73532
augaauccaaaucaaaagauaauaacgauuggcucuguuucucucaccauuuccacaauaugcuucuucaugcaaauugccaucuugauaacuacuguaacauugcauuucaagcaauauaaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaaugugacauuacgggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucgaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaauuguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagagguaauaggucagguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51044 - RNA, 1410 nt, Artificial Sequence; identical to SEQ ID NO: 49914
  neuraminidase__InfluenzaA__AEA73543

SEQ ID NO: 51045 - RNA, 1410 nt, Artificial Sequence; identical to SEQ ID NO: 49914
  neuraminidase__InfluenzaA__AEA73554

SEQ ID NO: 51046 - RNA, 1410 nt, Artificial Sequence; identical to SEQ ID NO: 49917
  neuraminidase__InfluenzaA__AEA73565

SEQ ID NO: 51047 - RNA, 1413 nt, Artificial Sequence
  neuraminidase__InfluenzaA__AEA73576
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgaugguccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgacccugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 51048 - RNA, 1413 nt, Artificial Sequence
  neuraminidase__InfluenzaA__AEA73587
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuugcucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuacgaggaaugcuccuguuacccagacacuggcauagugauguguguaugcagggacaacuggcaugguucaaaucgaccuuggguguccuuuaaucaaaauuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 51049 - RNA, 1413 nt, Artificial Sequence
  neuraminidase__InfluenzaA__AEA73598
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaauugaaugcacccaauuuuuauuacgaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguugauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 51050 - RNA, 1413 nt, Artificial Sequence
  neuraminidase__InfluenzaA__AEA73609
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguucaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 51051 - RNA, 1413 nt, Artificial Sequence; identical to SEQ ID NO: 50706
  neuraminidase__InfluenzaA__AEA73620

SEQ ID NO: 51052 - RNA, 1413 nt, Artificial Sequence
  neuraminidase__InfluenzaA__AEA73631
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuacgaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaucaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 51053 - RNA, 1413 nt, Artificial Sequence
  neuraminidase__InfluenzaA__AEA73642
augaacccaaaucaacggauaauaaccauuggaucaaucaguauagcaaucggaauaauuagucugauguugcaaauaggaaauauuauuucaauaugggcuagucacucaauccaaacuggaagucaaaacaacacuggaauaugcaaacaaagaaucaucacauaugaaaacagcaccugggugaaucauacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccgcaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccggugacuguugauggagcaaacggaguaaaaggguuuucauacaaauaugguaaugguguuugguuaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacacccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 51054 - RNA, 1413 nt, Artificial Sequence; identical to SEQ ID NO: 50706
  neuraminidase__InfluenzaA__AEA73653

SEQ ID NO: 51055 - RNA, 1413 nt, Artificial Sequence
  neuraminidase__InfluenzaA__AEA73664
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuacgaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguuaauggagcagacggagugaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuaaagaaaauacaacaaucuggacuagugggagcagcauuucuuuuuguggcguuaauagugauacugcaaacuggucuuggccagacggugcugaguugccguucaccauugacaaguag

SEQ ID NO: 51056 - RNA, 1413 nt, Artificial Sequence
  neuraminidase__InfluenzaA__AEA73675
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcaccuaauuuuuauuacgaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguugauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggauugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 51057 - RNA, 1413 nt, Artificial Sequence; identical to SEQ ID NO: 50715
  neuraminidase__InfluenzaA__AEA73686

SEQ ID NO: 51058 - RNA, 1413 nt, Artificial Sequence
  neuraminidase__InfluenzaA__AEA73697
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauauuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaguagaguugaaugcacccaauuuuuauuacgaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguuaauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 51059 - RNA, 1413 nt, Artificial Sequence; identical to SEQ ID NO: 50712
  neuraminidase__InfluenzaA__AEA73708

SEQ ID NO: 51060 - RNA, 1413 nt, Artificial Sequence; identical to SEQ ID NO: 50706
  neuraminidase__InfluenzaA__AEA73719

SEQ ID NO: 51061 - RNA, 1413 nt, Artificial Sequence; identical to SEQ ID NO: 50706
  neuraminidase__InfluenzaA__AEA73730

SEQ ID NO: 51062 - RNA, 1413 nt, Artificial Sequence; identical to SEQ ID NO: 50706
  neuraminidase__InfluenzaA__AEA73741

SEQ ID NO: 51063 - RNA, 1413 nt, Artificial Sequence; identical to SEQ ID NO: 50706
  neuraminidase__InfluenzaA__AEA73752

SEQ ID NO: 51064 - RNA, 1413 nt, Artificial Sequence
  neuraminidase__InfluenzaA__AEA73763
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguauuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuacgaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguugauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 51065 - RNA, 1410 nt, Artificial Sequence; identical to SEQ ID NO: 47242
  neuraminidase__InfluenzaA__AEA73774

SEQ ID NO: 51066 - RNA, 1410 nt, Artificial Sequence
  neuraminidase__InfluenzaA__AEA73784
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcaguggaauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51067 - RNA, 1410 nt, Artificial Sequence; identical to SEQ ID NO: 47242
  neuraminidase__InfluenzaA__AEA73794

SEQ ID NO: 51068 - RNA, 1410 nt, Artificial Sequence; identical to SEQ ID NO: 48036
  neuraminidase__InfluenzaA__AEA73804

SEQ ID NO: 51069 - RNA, 1410 nt, Artificial Sequence; identical to SEQ ID NO: 47242
  neuraminidase__InfluenzaA__AEA73814

SEQ ID NO: 51070 - RNA, 1410 nt, Artificial Sequence; identical to SEQ ID NO: 47242
  neuraminidase__InfluenzaA__AEA73824

SEQ ID NO: 51071 - RNA, 1410 nt, Artificial Sequence
  neuraminidase__InfluenzaA__AEA73834
augaauccaaaccaaaagauaauaaccauugguucgaucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggaaaaacaauaucuugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51072 - RNA, 1410 nt, Artificial Sequence
  neuraminidase__InfluenzaA__AEA73844
augaauccaaaccaaaagauaauaaccauugguucggucuguaugacaauuggaauggcuaauuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcaugaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51073 - RNA, 1410 nt, Artificial Sequence; identical to SEQ ID NO: 48286
  neuraminidase__InfluenzaA__AEA73854

SEQ ID NO: 51074 - RNA, 1410 nt, Artificial Sequence
  neuraminidase__InfluenzaA__AEA73864
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagguuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51075 - RNA, 1410 nt, Artificial Sequence; identical to SEQ ID NO: 49126
  neuraminidase__InfluenzaA__AEA73874

SEQ ID NO: 51076 - RNA, 1410 nt, Artificial Sequence; identical to SEQ ID NO: 49126
  neuraminidase__InfluenzaA__AEA73884

SEQ ID NO: 51077 - RNA, 1410 nt, Artificial Sequence; identical to SEQ ID NO: 50604
  neuraminidase__InfluenzaA__AEA73894

SEQ ID NO: 51078 - RNA, 1410 nt, Artificial Sequence
  neuraminidase__InfluenzaA__AEA73904
augaauccaaaccaaaagauaauaaccauugguucggucuguaugacaauuggaauggcuaacuuaguauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucauaggaauaaaugaguggucaggauauagcgggaguuuuguccagcauccagaacuaacagggcuggauuguauaagaccuugcuucuggguugaacuaaucagagggcgacccaaagagaaaacaaucuggacuagcgggagcagcauauccuuuugugguguaaacagugacacuguggguuggucuuggccagacggugcugaguugccauuuaccauugacaaguaa

SEQ ID NO: 51079 - RNA, 1410 nt, Artificial Sequence; identical to SEQ ID NO: 48663
  neuraminidase__InfluenzaA__AEA73914

SEQ ID NO: 51080 - RNA, 1410 nt, Artificial Sequence; identical to SEQ ID NO: 49126
  neuraminidase__InfluenzaA__AEA73924

SEQ ID NO: 51081 - RNA, 1410 nt, Artificial Sequence
  neuraminidase__InfluenzaA__AEA73934
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugagacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51082 - RNA, 1410 nt, Artificial Sequence
  neuraminidase__InfluenzaA__AEA73944
augaauccaaaccaaaagauaauaaccauugguucggucuguaugacaauuggaauggcuaacuuaauauuacaaguuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51083 - RNA, 1410 nt, Artificial Sequence
  neuraminidase__InfluenzaA__AEA73954
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguuccuucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51084 - RNA, 1410 nt, Artificial Sequence; identical to SEQ ID NO: 48286
  neuraminidase__InfluenzaA__AEA73964

SEQ ID NO: 51085 - RNA, 1410 nt, Artificial Sequence
  neuraminidase__InfluenzaA__AEA73974
augaauccaaaccaaaagauaauaaccauugguucggucuguaugacaauuggaauggcuaacuuaauauuacaaauuggaaacauaaucucaauauggauuagccacucaauucaacaugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggaucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51086 - RNA, 1410 nt, Artificial Sequence; identical to SEQ ID NO: 48286
  neuraminidase__InfluenzaA__AEA73984

SEQ ID NO: 51087 - RNA, 1410 nt, Artificial Sequence; identical to SEQ ID NO: 48668
  neuraminidase__InfluenzaA__AEA73994

SEQ ID NO: 51088 - RNA, 1410 nt, Artificial Sequence
  neuraminidase__InfluenzaA__AEA74004
augaauccaaacaaaaagauaauaaucauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51089 - RNA, 1410 nt, Artificial Sequence
  neuraminidase__InfluenzaA__AEA74014
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacacuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuacccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaaauucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51090 - RNA, 1410 nt, Artificial Sequence; identical to SEQ ID NO: 51089
  neuraminidase__InfluenzaA__AEA74024

SEQ ID NO: 51091 - RNA, 1410 nt, Artificial Sequence
  neuraminidase__InfluenzaA__AEA74032
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggcccuacuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaccgaccgugggugucuuucaaccagaaucuggaauaucagauaggauacauaugcagugggauuuucggagacaauccacguccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaacgaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguugguuggucuuggccagacggugcugaguugccauuuaccauugacaaguaa

SEQ ID NO: 51092 - RNA, 1410 nt, Artificial Sequence; identical to SEQ ID NO: 51091
  neuraminidase__InfluenzaA__AEA74034

SEQ ID NO: 51093 - RNA, 1410 nt, Artificial Sequence
  neuraminidase__InfluenzaA__AEA77302
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaaaaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaagguuccaauaggcccaucguagauauaaacauaaaggaucauagcauuguuuccaguuauguguguucaggacuuguuggagacacacccaaaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaagucaaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51094 - RNA, 1410 nt, Artificial Sequence
  neuraminidase__InfluenzaA__AEB21318
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51095 - RNA, 1410 nt, Artificial Sequence
  neuraminidase__InfluenzaA__AEB21328
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcuucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucaugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauguccuuuugugguguaaacagugacacuguggguuggucuuggccagacggugcugaguugccauuuaccauugacaaguaa

SEQ ID NO: 51096 - RNA, 1410 nt, Artificial Sequence; identical to SEQ ID NO: 51094
  neuraminidase__InfluenzaA__AEB21340

SEQ ID NO: 51097 - RNA, 1410 nt, Artificial Sequence
  neuraminidase__InfluenzaA__AEB21350
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccucggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuauuucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51098 - RNA, 1410 nt, Artificial Sequence
  neuraminidase__InfluenzaA__AEB21360
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51099 - RNA, 1410 nt, Artificial Sequence; identical to SEQ ID NO: 50787
  neuraminidase__InfluenzaA__AEB40209

SEQ ID NO: 51100 - RNA, 1410 nt, Artificial Sequence; identical to SEQ ID NO: 48087
  neuraminidase__InfluenzaA__AEB66898

SEQ ID NO: 51101 - RNA, 1413 nt, Artificial Sequence
  neuraminidase__InfluenzaA__AEB71103
augaauccaaaucagaaaauaauaaccauaggcuccguaucauugggacugguuguauucaauguucuauuacaugucgugagcaucauaguaacaguagugguccuggggaaugacgggggcaauggaauauguaaugggacgguagugaaggaauacaaugagacagucagaauagaaagggugauucaauggcacaacacuaguguaguugaauacauaccauauuugaauggaggcaccuacaccaacaauacagaaucaguaugugacgucaagggcuuugcaccuuucucaaaggacaacggaguaagaauuggcucuaggggacauguuuuugucauaagggaaccuuuugucuccuguucgcccagggagugcagaacuuucuuccucacccagggguccuuacucaaugacaaacacucgaauggaacagugaaggauagaagcccauucaaaacucuuaugagugucgaaguaggucaaucacccaauguauaccaagccagguuugaagcuguagcguggucagcgaccgccugccaugaugggaagaaguggaugacgauugguguaacagggccugauuccaaagcaguggcaguaguccauuaugggggggugccuacugauaucauuaauuccugggcaggagauauuuugagaacucaagagucauccugcacuugcauacagggugauugcuacugggugaugacugacggcccugccaacaggcaggcgcaguacagaauauacaaaucuaaucaaggcaagauaauuggucagauggauaucaacuuuaaugggggucauauugaagaguguucuugcuacccuaaugauggcaagguggaaugcguuuguagagacaacuggacagggaccaaccggccugugcuggugauuucgccugaucucucuuacaaaguuggguauuugugugcagggcugccaagcgacaccccaagaggggaggaugcccaauucuccgguucuugcaccagucccguggggggucaaggguaugguguaaaagguuuuggauuccgacagggaaaugauguauggauggggaggacaauuagucgaaccuccaggucaggauuugagguaauaagaguaaagaaugguuggacacagacaaguaaagaacagauuagaaaacaaguaguuguugauaauuugaauuggucgggguacaguggaucuuuuacccugccaauagaauugucugggaaaagcuguuugguucccuguuuuuggguagaaacgaucagagguaaaccugaggagaaaacaaucuggaccuccagcagcuccauugugauguguggaguugauuaugaagucgccgauuggucguggcacgauggagcuauucuuccuuuugacaucgauaagauguaa

SEQ ID NO: 51102 - RNA, 1413 nt, Artificial Sequence; identical to SEQ ID NO: 50745
  neuraminidase__InfluenzaA__AEB71899

SEQ ID NO: 51103 - RNA, 1410 nt, Artificial Sequence
  neuraminidase__InfluenzaA__AEB71910
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccuacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51104 - RNA, 1410 nt, Artificial Sequence; identical to SEQ ID NO: 47242
  neuraminidase__InfluenzaA__AEB71919

SEQ ID NO: 51105 - RNA, 1410 nt, Artificial Sequence
  neuraminidase__InfluenzaA__AEB71928
augaauccaaaucaaaagauaauaacgauuggcucuguuucucucaccauuuccacaauaugcuucuucaugcaaauugccaucuugguaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgaucccgacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcgaacaucaaucucaugccuauauaa

SEQ ID NO: 51106 - RNA, 1410 nt, Artificial Sequence
  neuraminidase__InfluenzaA__AEB71939
augaauccaaaucaaaagauaauaacgauuggcucuguuucucucaccauuuccgcaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcgucuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgauuagcgagaagucacgcuuaggguaugaaacuuucaaagucauugaaggcugguccaaccauaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucgaacaguauuguuguguuuuguggcaccucagguacauauggaacaggcucauggccugauggggcggaccucaaucucaugccuauauaa

SEQ ID NO: 51107 - RNA, 1410 nt, Artificial Sequence
  neuraminidase__InfluenzaA__AEB71950
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcgucuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaaggugaucauggagugaaaggcugggccuuugaugauggaaaugacguguggaugggaagaacgaucagcgagaagucacgcuuaggguaugaaaccuucaaagucauugaaggcugguccaaccauaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51108 - RNA, 1413 nt, Artificial Sequence
  neuraminidase__InfluenzaA__AEB71961
augaacccaaaucaacggauaauaaccauuggaucaaucaguauagcaaucggaauaauuagucugauguugcaaauaggaaauauuauuucaauaugggcuagucacucaauccaaacuggaagucaaaacaacacuggaauaugcaaccaaagaaucaucacauaugaaaacagcaccugggugaaucauacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccgcaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguauuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccggugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacacccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 51109 - RNA, 1410 nt, Artificial Sequence
  neuraminidase__InfluenzaA__AEB71972
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagugaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51110 - RNA, 1410 nt, Artificial Sequence
  neuraminidase__InfluenzaA__AEB71983
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggauccaauaggcccaucguagauauaaacaugaaggaucauagcauuguuuccaguuauguguguucaggacuuguuggagacacacccagaagaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51111 - RNA, 1413 nt, Artificial Sequence
  neuraminidase__InfluenzaA__AEB71995
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauauuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuacgaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccaguaacuguuaauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggaauguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 51112 - RNA, 1413 nt, Artificial Sequence; identical to SEQ ID NO: 50709
  neuraminidase__InfluenzaA__AEC13316

SEQ ID NO: 51113 - RNA, 1410 nt, Artificial Sequence; identical to SEQ ID NO: 47445
  neuraminidase__InfluenzaA__AEC53262

SEQ ID NO: 51114 - RNA, 1410 nt, Artificial Sequence; identical to SEQ ID NO: 47445
  neuraminidase__InfluenzaA__AEC53272

SEQ ID NO: 51115 - RNA, 1410 nt, Artificial Sequence; identical to SEQ ID NO: 47445
  neuraminidase__InfluenzaA__AEC53282

SEQ ID NO: 51116 - RNA, 1410 nt, Artificial Sequence; identical to SEQ ID NO: 47445
  neuraminidase__InfluenzaA__AEC53292

SEQ ID NO: 51117 - RNA, 1410 nt, Artificial Sequence
  neuraminidase__InfluenzaA__AEC53302
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacauuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauauguagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51118 - RNA, 1410 nt, Artificial Sequence; identical to SEQ ID NO: 47445
  neuraminidase__InfluenzaA__AEC53350

SEQ ID NO: 51119 - RNA, 1410 nt, Artificial Sequence; identical to SEQ ID NO: 48139
  neuraminidase__InfluenzaA__AEC53407

SEQ ID NO: 51120 - RNA, 1410 nt, Artificial Sequence; identical to SEQ ID NO: 47439
  neuraminidase__InfluenzaA__AEC53427

SEQ ID NO: 51121 - RNA, 1410 nt, Artificial Sequence; identical to SEQ ID NO: 48900
  neuraminidase__InfluenzaA__AED99967

SEQ ID NO: 51122 - RNA, 1410 nt, Artificial Sequence; identical to SEQ ID NO: 47241
  neuraminidase__InfluenzaA__AEE27161

SEQ ID NO: 51123 - RNA, 1410 nt, Artificial Sequence; identical to SEQ ID NO: 47242
  neuraminidase__InfluenzaA__AEE27170

SEQ ID NO: 51124 - RNA, 1410 nt, Artificial Sequence; identical to SEQ ID NO: 50067
  neuraminidase__InfluenzaA__AEE27180

SEQ ID NO: 51125 - RNA, 1410 nt, Artificial Sequence
  neuraminidase__InfluenzaA__AEE27190
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcguaauaacagacacuaucaagaguuggagaaacaauauauugagaacacaagagucugaaugugcauguguaaaugguucuugcuuuacuguaaugaccgauggaccaaguaauggacaggccucauacaagaucuucaaaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51126 - RNA, 1410 nt, Artificial Sequence; identical to SEQ ID NO: 48465
  neuraminidase__InfluenzaA__AEE27200

SEQ ID NO: 51127 - RNA, 1410 nt, Artificial Sequence
  neuraminidase__InfluenzaA__AEG64755
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugauaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcguguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuauugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcggaaguuuuguucagcauccggaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51128 - RNA, 1362 nt, Artificial Sequence
  neuraminidase__InfluenzaA__AEG64765
augaauccaaaccagaaaauaauaaccauugggucaaucuguaugguagucggaauaauuagccuaauauugcaaauagggaauauaaucucaauauggauuagccauucaauucaaaccggaaaucaaaaccauacuggaauaugcaaccaaggcaucauuaccuauaacguuguugcugggcaggacucaacuucagugauauuaaccggcaauucaucucuuugucccauccgugggugggcuauacacagcaaagacaauggcauaagaauugguuccaaaggagacguuuuugucauaagagagccuuuuauuucauguucucacuuggaaugcaggaccuuuuuucugacucaaggcgccuuacugaaugacaagcauucaaaugggaccguuaaggacagaagcccuuauagggccuuaaugagcugcccugucggugaagcuccguccccguacaauucaagguuugaaucgguugcuuggucagcaagugcaugucaugauggcaugggcuggcuaacaaucggaauuucugguccagauaauggagcaguggcuguauuaaaauacaacggcauaauaacugaaaccauaaaaaguuggaggaagaaaauauugagaacacaagagucugaauguaccuguguaaaugguucauguuuuaccauaaugaccgauggcccaagugaugggcuggccucguacaaaauuuucaagaucgagaaggggaagguuacuaaaucaauagaguugaaugcaccuaauucucacuacgaggaauguuccuguuacccugauaccggcaaagugaugugugugugcagagacaauuggcacgguucgaaccgaccauggguguccuucgaccaaaaccuagauuaucaaauaggauacaucugcagugggguuuucggugacaacccgcgucccaaagauggaacaggcagcuguggcccagugucugcugauggagcaaacggaguaaagggauuuucauauagguaugguaaugguguuuggauaggaaggacuaaaagugacaguuccagacauggguuugagaugauuugggauccuaauggauggacagagacugauaguagguucucugugagacaagauguuguggcaaugacugaucggucaggguacagcggaaguuucguucaacauccugagcuaacagggcuagacuguaugaggccuugcuucuggguugaauuaaucaggggacgaccugaggagaaaacaaucuggacuagugggagcaucauuucuuuuuguggcgugaauagugauacuguagauuggucuuggccagacggugcugaguugccguucaccauugacaaguag

SEQ ID NO: 51129 - RNA, 1410 nt, Artificial Sequence
  neuraminidase__InfluenzaA__AEG64787
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauagauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggacccgaacggauggacugggacagacaaugacuucucaauaaagcaagauaucguaggaauaaaugaguggucaggauauagcgggaguuuuguucagcauccagaacuaacagggcuggauuguauaagaccuugcuucuggguugaauuaaucagagggcgacccaaagagaacacaaucuggacuagcgggagcagcauauccuuuugugguguaaacagugacacuguggguuggucuuggccagacggugcugaguugccauucaccauugacaaguaa

SEQ ID NO: 51130 - RNA, 1410 nt, Artificial Sequence
  neuraminidase__InfluenzaA__AEG64837
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaaugugacauuacaggauuugcacccuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaacgaguuagguguuccuuuucaucuggggaccaagcaagugugcaucgcaugguccagcucaaguugucacgauggaaaagcauggcugcauguuuguauaacgggagaugauaaaaaugcaacugcuagccucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51131 - RNA, 1410 nt, Artificial Sequence
  neuraminidase__InfluenzaA__AEG64848
augaacccaaaucaaaagauaauaacgauuggcucuguuucucucaccauuuccacaauaugcuucuucaugcaaauugccaucuugauaacuacuguaacauugcauuucaagcaauaugaauucuacucccccccaaacaaccaagugaugcugugugaaccaacaauaauagaaagaaacauaacagagauaguguaucugaccaacaccaccauagagaaggaaauaugccccaaacuagcagaauacagaaauugguuaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaagcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51132 - RNA, 1410 nt, Artificial Sequence; identical to SEQ ID NO: 44737
  neuraminidase__InfluenzaA__AEG64859

SEQ ID NO: 51133 - RNA, 1410 nt, Artificial Sequence; identical to SEQ ID NO: 44673
  neuraminidase__InfluenzaA__AEG64870

SEQ ID NO: 51134 - RNA, 1410 nt, Artificial Sequence
  neuraminidase__InfluenzaA__AEG64881
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguauaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaauuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 51135 - RNA, 1410 nt, Artificial Sequence; identical to SEQ ID NO: 44673
  neuraminidase__InfluenzaA__AEG64892

SEQ ID NO: 51136 - RNA, 1410 nt, Artificial Sequence
  neuraminidase__InfluenzaA__AEG64914
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggugacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucgaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggaguguuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 51137 - RNA, 1410 nt, Artificial Sequence; identical to SEQ ID NO: 44646
  neuraminidase__InfluenzaA__AEG64925

SEQ ID NO: 51138 - RNA, 1410 nt, Artificial Sequence
  neuraminidase__InfluenzaA__AEG64936
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggugacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaggauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggaguguuccuguuauccucgauaucccggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugaugggaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 51139 - RNA, 1410 nt, Artificial Sequence
  neuraminidase__InfluenzaA__AEG64947
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagagggaaauaugccccaaacuagcagaauacagaaauuggucaaagccgcaauguaacauuacaggauuugcaccuuuuucuaaggacaauucgauucgacuuuccgcugguggugacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggaguguuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccuagauccuaacaaugaggaggguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 51140 - RNA, 1410 nt, Artificial Sequence
  neuraminidase__InfluenzaA__AEG64958
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggugacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggaguguuccuguuauccucgauauccuggugucagaugugucugcagagacaacuggaaaggcuccaauaggcccauuguagauauaaauguuaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 51141 - RNA, 1410 nt, Artificial Sequence
  neuraminidase__InfluenzaA__AEG64969
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggugacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugacaaaaaugcaacugcuagcuucauuuacaaugggaggcuuguagauaguauugguucaugguccaaaaaaauacucagaacccaggagucagaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggaguguuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 51142 - RNA, 1410 nt, Artificial Sequence
  neuraminidase__InfluenzaA__AEG64980
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggugacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugccagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauuuauugaggaggggaaaaucguucauauuagcacauugucaggaagugcucagcaugucgaggaguguuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 51143 - RNA, 1410 nt, Artificial Sequence
  neuraminidase__InfluenzaA__AEG64991
augaauccaaaucaaaagauaauaacgauuggcucuguuucucucaccauuuccacaauaugcuucuucaugcaaauugccaucuugauaacuacuguaacauugcauuucaagcaauaugaauccaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagacaaauaggcaagucauaguugacagagguaauagguccgguuauucuggcauuuucucuguugaaggcaaaagcugcaucaaucggugcuuuuauguggaguugauaaggggaagaaaagaggaaacugaagucuuguggaccucaaacaguauuguuguguucuguggcaccucagguacauauggaacaggcucauggccugauggggcggacaucaaucucaugccuauauaa

SEQ ID NO: 51144 - RNA, 1410 nt, Artificial Sequence
  neuraminidase__InfluenzaA__AEG65002
augaauccaaaucaaaagauaauaacgauuggcucuguuucucucaccauuuccacaauaugcuucuuuaugcaaauugccaucuugauaacuacuguaacauuacauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagauccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggagcggacaucaaucucaugccuauauaa

SEQ ID NO: 51145 - RNA, 1410 nt, Artificial Sequence
  neuraminidase__InfluenzaA__AEG65013
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuccaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagauauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguugcgcuuaggauaugaaaccuucaaagucauugaaggcugguccaacccuaauuccaaauugcagacaaauaggcaagucauaguugaaagagguaauagguccgguuauucuggcauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51146 - RNA, 1410 nt, Artificial Sequence
  neuraminidase__InfluenzaA__AEG65024
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccacgugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagauaaauaggcaagucauaguugacagagguaauagauccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51147 - RNA, 1410 nt, Artificial Sequence
  neuraminidase__InfluenzaA__AEG65035
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaguaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgaucuugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucaacaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuuuaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaaugaagucuuguggaccucaaacaguauuguuguguuuuguggcaccucagguacauauggaacaggcucauggccugauggggcggacaucaaucuuaugccuauauaa

SEQ ID NO: 51148 - RNA, 1410 nt, Artificial Sequence
  neuraminidase__InfluenzaA__AEG65057
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuuuauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaguguuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggauaucaaucucaugccuauauaa

SEQ ID NO: 51149 - RNA, 1410 nt, Artificial Sequence; identical to SEQ ID NO: 47076
  neuraminidase__InfluenzaA__AEG65068

SEQ ID NO: 51150 - RNA, 1410 nt, Artificial Sequence
  neuraminidase__InfluenzaA__AEG65079
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcuaagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguggccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51151 - RNA, 1410 nt, Artificial Sequence
  neuraminidase__InfluenzaA__AEG65090
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggguuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcacucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucauucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugaugggaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucagucucaugccuauauaa

SEQ ID NO: 51152 - RNA, 1410 nt, Artificial Sequence
  neuraminidase__InfluenzaA__AEG65101
augaauccaaaucaaaagauaauaacgauuggcucuguuucucucaccauuuccacaauaugcuucuucaugcaaauugccaucuugauaacuacuguaacauugcauuucaagcaauaugaauucaacucccccccagacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaacgacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguguuguuucaugguccaaagauauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaaaaauuauagcauuguuuccaguuaugugugcucaggacuuguuggagacacacccagaaaaaccgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguauuuuguggaaccucagguacauauggaacaggcucauggccugauggggcggacaucaaucucaugccuauauaa

SEQ ID NO: 51153 - RNA, 1410 nt, Artificial Sequence
  neuraminidase__InfluenzaA__AEG65123
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaacaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaacccuaugugucaugcgauccugacaaguguuaucaauuugcccuuggacagggaacaacacuaaacaacgugcauucaaacgacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguguuguuucaugguccaaagauauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcauguugaggagugcuccugcuauccucgauauccuggugucagaugugucugcagagacaacuggaaaggcuccaauaggcccauuguagauauaaacauaaagaauuauagcauuguuuccaguuaugugugcucaggacuuguuggagacacacccagaaaaaccgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaaugaagucuuguggaccucaaacaguauuguuguauuuuguggaaccucagguacauauggaacaggcucauggccugauggggcggacaucaaucucaugccuauauaa

SEQ ID NO: 51154 - RNA, 1410 nt, Artificial Sequence
  neuraminidase__InfluenzaA__AEG65134
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaacgacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguguuguuucaugguccaaagauauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaaaaauuauagcauuguuuccaguuaugugugcucaggacuuguuggagacacacccagaaaaaccgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguauuuuguggaaccucagguacauauggaacaggcucauggccugauggggcggacaucaaucucaugccuauauaa

SEQ ID NO: 51155 - RNA, 1410 nt, Artificial Sequence
  neuraminidase__InfluenzaA__AEG65145
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcccagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaauagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 51156 - RNA, 1410 nt, Artificial Sequence
  neuraminidase__InfluenzaA__AEG65156
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauacuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 51157 - RNA, 1410 nt, Artificial Sequence
  neuraminidase__InfluenzaA__AEG65167
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggacccccuaccggacccuauugaugaaugaauuggguguuccauuucauuugggaaccaggcaagugugcauagcaugguccagcucaaguugucacgacggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucggcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 51158 - RNA, 1410 nt, Artificial Sequence
  neuraminidase__InfluenzaA__AEG65178
augaauccaaaucaaaagauaauaacaauuggcucuguuucucucaccauugccacaauaugcuuccuuaugcaaauugccauccugguaacuacuguaacuuugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaauaacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaauauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 51159 - RNA, 1410 nt, Artificial Sequence
  neuraminidase__InfluenzaA__AEG65189
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuucugcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaugauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51160 - RNA, 1410 nt, Artificial Sequence
  neuraminidase__InfluenzaA__AEG65200
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcuaugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaggcauggcugcauguuuguguaacgggggaugauaaaaaugcaacugcuagcuucauuuacaaugggaggcuuguagauaguauuguuucaugguccaaagaaguccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51161 - RNA, 1410 nt, Artificial Sequence; identical to SEQ ID NO: 46236
  neuraminidase__InfluenzaA__AEG65211

SEQ ID NO: 51162 - RNA, 1410 nt, Artificial Sequence; identical to SEQ ID NO: 47202
  neuraminidase__InfluenzaA__AEG65222

SEQ ID NO: 51163 - RNA, 1410 nt, Artificial Sequence
  neuraminidase__InfluenzaA__AEG65233
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagaaaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucauagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51164 - RNA, 1410 nt, Artificial Sequence
  neuraminidase__InfluenzaA__AEG65244
augaauccaaaucaaaagauaauaacgauuggcucuguuucccucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacaucacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggacccagcaagugugcauagcaugguccagcucaaguugucacgauggaaaagcauggcugcauguuuguguaacgggggaugaugaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaagauacuauucauugaggaagggaaaauuguucauacuagcacauuaucaggaagugcucagcaugucgaggagugcuccuguuauccucgauauccuggugucagaugugucugcagagacaacuggaaaggcuccaauaggcccaucguagauauaaacauuaaggauuauagcauugcuuccaguuaugugugcucaggacuuguuggagacacacccagaaaaaacgacagcuccagcaguagccauugcuuggauccaaacaaugaggaagguggucauggagugaaaggcugggccuuugaugauggaaaugacguguggaugggaagaacgaucagcgagaaguuacgcucaggauaugaaaccuucaaagucauugaaggcugguccaacccuaacuccaaauugcagauaaauaggcaagucauaguugacagagguaacagguccgguuauucugguauuuucucuguugaaggcaaaagcugcaucaaucggugcuuuuauguggaguugauaaggggaagaaaccaggaaacugaagucuuguggaccucaaacaguauuguuguguuuuguggcaccucagguacauauggaacaggcucauggccugauggggcggacaucaaucucaugccuauauaa

SEQ ID NO: 51165 - RNA, 1410 nt, Artificial Sequence
  neuraminidase__InfluenzaA__AEG65255
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauaccaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51166 - RNA, 1410 nt, Artificial Sequence; identical to SEQ ID NO: 45095
  neuraminidase__InfluenzaA__AEG65266

SEQ ID NO: 51167 - RNA, 1410 nt, Artificial Sequence; identical to SEQ ID NO: 45095
  neuraminidase__InfluenzaA__AEG65277

SEQ ID NO: 51168 - RNA, 1410 nt, Artificial Sequence
  neuraminidase__InfluenzaA__AEG65288
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacaacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 51169 - RNA, 1410 nt, Artificial Sequence; identical to SEQ ID NO: 45095
  neuraminidase__InfluenzaA__AEG65299

SEQ ID NO: 51170 - RNA, 1410 nt, Artificial Sequence; identical to SEQ ID NO: 51165
  neuraminidase__InfluenzaA__AEG65310

SEQ ID NO: 51171 - RNA, 1410 nt, Artificial Sequence; identical to SEQ ID NO: 51165
  neuraminidase__InfluenzaA__AEG65321

SEQ ID NO: 51172 - RNA, 1410 nt, Artificial Sequence; identical to SEQ ID NO: 47202
  neuraminidase__InfluenzaA__AEG65332

SEQ ID NO: 51173 - RNA, 1410 nt, Artificial Sequence; identical to SEQ ID NO: 47202
  neuraminidase__InfluenzaA__AEG65354

SEQ ID NO: 51174 - RNA, 1410 nt, Artificial Sequence; identical to SEQ ID NO: 47202
  neuraminidase__InfluenzaA__AEG65365

SEQ ID NO: 51175 - RNA, 1410 nt, Artificial Sequence
  neuraminidase__InfluenzaA__AEG65376
augaauccaaaucaaaagauaauaacgauuggcucuguuucccucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggacccagcaagugugcauagcaugguccagcucaaguugucacgauggaaaagcauggcugcauguuuguguaacgggggaugaugaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaagauacuauucauugaggaagggaaaauuguucauacuagcacauuaucaggaagugcucagcaugucgaggagugcuccuguuauccucgauauccuggugucagaugugucugcagagacaacuggaaaggcuccaauaggcccaucguagauauaaacauuaaggauuauagcauuguuuccaguuaugugugcucaggacuuguuggagacacacccagaaaaaacgacagcuccagcaguagccauugcuuggauccaaacaaugaggaagguggucauggagugaaaggcugggccuuugaugauggaaaugacguguggaugggaagaacgaucagcgagaaguuacgcucaggauaugaaaccuucaaagucauugaaggcugguccaacccuaacuccaaauugcagauaaauaggcaagucauaguugacagagguaacagguccgguuauucugguauuuucucuguugaaggcaaaagcugcaucaaucggugcuuuuauguggaguugauaaggggaagaaaccaggaaacugaagucuuguggaccucaaacaguauuguuguguuuuguggcaccucagguacauauggaacaggcucauggccugauggggcggacaucaaucucaugccuauauaa

SEQ ID NO: 51176 - RNA, 1410 nt, Artificial Sequence; identical to SEQ ID NO: 45095
  neuraminidase__InfluenzaA__AEG65387

SEQ ID NO: 51177 - RNA, 1410 nt, Artificial Sequence; identical to SEQ ID NO: 45095
  neuraminidase__InfluenzaA__AEG65398

SEQ ID NO: 51178 - RNA, 1410 nt, Artificial Sequence; identical to SEQ ID NO: 45095
  neuraminidase__InfluenzaA__AEG65409

SEQ ID NO: 51179 - RNA, 1410 nt, Artificial Sequence; identical to SEQ ID NO: 45095
  neuraminidase__InfluenzaA__AEG65420

SEQ ID NO: 51180 - RNA, 1410 nt, Artificial Sequence; identical to SEQ ID NO: 45095
  neuraminidase__InfluenzaA__AEG65431

SEQ ID NO: 51181 - RNA, 1410 nt, Artificial Sequence; identical to SEQ ID NO: 45232
  neuraminidase__InfluenzaA__AEG65442

SEQ ID NO: 51182 - RNA, 1410 nt, Artificial Sequence
  neuraminidase__InfluenzaA__AEG65453
augaauccaaaucaaaagauaauaacgauuggcucuguuucucucaccauuuccacaauaugcuucuucaugcaaauugccaucuugauaacuacuguaacauugcacuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51183 - RNA, 1410 nt, Artificial Sequence; identical to SEQ ID NO: 51182
  neuraminidase__InfluenzaA__AEG65464

SEQ ID NO: 51184 - RNA, 1410 nt, Artificial Sequence; identical to SEQ ID NO: 51182
  neuraminidase__InfluenzaA__AEG65475

SEQ ID NO: 51185 - RNA, 1410 nt, Artificial Sequence
  neuraminidase__InfluenzaA__AEG65486
augaauccaaaucaaaagauaauaacgauuggcucuguuucucucaccauuuccacaauaugcuucuucaugcaaauugccaucuugauaacuacuguaacauugcacuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaacacaggaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51186 - RNA, 1410 nt, Artificial Sequence; identical to SEQ ID NO: 51182
  neuraminidase__InfluenzaA__AEG65497

SEQ ID NO: 51187 - RNA, 1410 nt, Artificial Sequence; identical to SEQ ID NO: 51182
  neuraminidase__InfluenzaA__AEG65508

SEQ ID NO: 51188 - RNA, 1410 nt, Artificial Sequence; identical to SEQ ID NO: 51182
  neuraminidase__InfluenzaA__AEG65519

SEQ ID NO: 51189 - RNA, 1410 nt, Artificial Sequence; identical to SEQ ID NO: 51182
  neuraminidase__InfluenzaA__AEG65530

SEQ ID NO: 51190 - RNA, 1410 nt, Artificial Sequence; identical to SEQ ID NO: 51182
  neuraminidase__InfluenzaA__AEG65541

SEQ ID NO: 51191 - RNA, 1410 nt, Artificial Sequence
  neuraminidase__InfluenzaA__AEG65563
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccacaaugugacauuacaggauuugcaccuuuuucuaaggacaauucgauuaggcuuuccgcugguggggacaucugggugacaagagaaccuuaugugucaugcgauccugacagguguuaucaauuugcccuuggacagggaacuacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51192 - RNA, 1410 nt, Artificial Sequence
  neuraminidase__InfluenzaA__AEG65574
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaguuggucaaagccacaaugugacauuacaggauuugcaccuuuuucuaaggacaauucgauuaggcuuuccgcugguggggacaucugggugacaagagaaccuuaugugucaugcgauccugacagguguuaucaauuugcccuuggacagggaacuacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51193 - RNA, 1410 nt, Artificial Sequence; identical to SEQ ID NO: 51191
  neuraminidase__InfluenzaA__AEG65585

SEQ ID NO: 51194 - RNA, 1410 nt, Artificial Sequence; identical to SEQ ID NO: 51191
  neuraminidase__InfluenzaA__AEG65596

SEQ ID NO: 51195 - RNA, 1410 nt, Artificial Sequence
  neuraminidase__InfluenzaA__AEG65607
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggacgauaaaaaugcaacugcuagcuucauuuacaaugggaggcuuguagauaguauuguuucaugguccaaaaaaauccucaggacccaggagucagaaugcguuuguaucaauggaacuuguacaguaguaaugaccgaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauugcuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggguaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51196 - RNA, 1410 nt, Artificial Sequence
  neuraminidase__InfluenzaA__AEG65629
augaauccaaaccaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagcgcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacgaugaggaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaauugaagucuuguggaccucaaacaguauuguuguguuuuguggcaccucagguacauauggaacaggcucauggccugauggggcggacaucaaucucaugccuauauaa

SEQ ID NO: 51197 - RNA, 1410 nt, Artificial Sequence; identical to SEQ ID NO: 51196
  neuraminidase__InfluenzaA__AEG65640

SEQ ID NO: 51198 - RNA, 1410 nt, Artificial Sequence; identical to SEQ ID NO: 44644
  neuraminidase__InfluenzaA__AEG65651

SEQ ID NO: 51199 - RNA, 1410 nt, Artificial Sequence; identical to SEQ ID NO: 47202
  neuraminidase__InfluenzaA__AEG65662

SEQ ID NO: 51200 - RNA, 1410 nt, Artificial Sequence; identical to SEQ ID NO: 47202
  neuraminidase__InfluenzaA__AEG65673

SEQ ID NO: 51201 - RNA, 1410 nt, Artificial Sequence; identical to SEQ ID NO: 47202
  neuraminidase__InfluenzaA__AEG65684

SEQ ID NO: 51202 - RNA, 1410 nt, Artificial Sequence; identical to SEQ ID NO: 51175
  neuraminidase__InfluenzaA__AEG65695

SEQ ID NO: 51203 - RNA, 1410 nt, Artificial Sequence
  neuraminidase__InfluenzaA__AEG65706
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaggaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaaugaagucuuguggaccucaaacaguauuguuguguuuuguggcaccucagguacauauggaacaggcucauggccugauggggcggacaucaaucuuaugccuauauaa

SEQ ID NO: 51204 - RNA, 1410 nt, Artificial Sequence
  neuraminidase__InfluenzaA__AEG65728
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaccuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggaaaucaaucucaugccuauauaa

SEQ ID NO: 51205 - RNA, 1410 nt, Artificial Sequence
  neuraminidase__InfluenzaA__AEG65739
augaauccaaaucaaaagauaauaacgauuggcucuguuucucucaccauuuccacaauaugcuucuucaugcaaauugccaucuugauaacuacuguaacauugcauuucaaacaauaugaauucagcucccccccaaacaaccaagugaugccgugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuagacuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguccauacuagcacauugucaggaagugcucaacaugucgaggagugcuccugcuauccucgauauccuggugucagaugugucugcagagacaacuggaaaggcuccaauaggcccaucguagauauaaacaugaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51206 - RNA, 1410 nt, Artificial Sequence
  neuraminidase__InfluenzaA__AEG65750
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcacccuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51207 - RNA, 1410 nt, Artificial Sequence
  neuraminidase__InfluenzaA__AEG65761
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaauuguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggaaaucaaucucaugccuauauaa

SEQ ID NO: 51208 - RNA, 1410 nt, Artificial Sequence
  neuraminidase__InfluenzaA__AEG65772
augaauccaaaucaaaagauaauaacgauuggcucuguuucucuuaccauuuccacaauaugcuuuuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaaugugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaccaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucauucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaaaccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51209 - RNA, 1410 nt, Artificial Sequence
  neuraminidase__InfluenzaA__AEG65783
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51210 - RNA, 1410 nt, Artificial Sequence
  neuraminidase__InfluenzaA__AEG65794
augaauccaaaucaaaagauaauaacgauuggcucuguuucucucaccauuuccacaauaugcuucuucaugcaaauugccaucuugauaacuacuauaacauugcauuucaagcaauaugaauucaacucccccccaaacaaccaagugaugcugugugaaccgacaauaauagaaagaaacauaacagagauaguguaucugaccaacaccaccauagagaaggaaauaugccccaaacuagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcaagcuucauuuacaaugggaggcuuguagauaguguuguuucaugguccaaagaaauucucaggacccaggagucagaauguguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauaguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuugggguaugaaaccuucaaagucauugaaggcugguccaacccuaaguccaaauugcagauaaauaggcaagucauaguugacaaagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51211 - RNA, 1410 nt, Artificial Sequence; identical to SEQ ID NO: 51209
  neuraminidase__InfluenzaA__AEG65805

SEQ ID NO: 51212 - RNA, 1410 nt, Artificial Sequence
  neuraminidase__InfluenzaA__AEG65816
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggagaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51213 - RNA, 1410 nt, Artificial Sequence
  neuraminidase__InfluenzaA__AEG79808
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagauaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaauauggacuagcgggagcagcauauccuuuugugguguaaacagugacacuguggguuggucuuggccagacggugcugaguugccauuuaccauugacaaguaa

SEQ ID NO: 51214 - RNA, 1410 nt, Artificial Sequence
  neuraminidase__InfluenzaA__AEG79814
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugaaaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51215 - RNA, 1410 nt, Artificial Sequence
  neuraminidase__InfluenzaA__AEG79826
augaauccaaaccaaaagauaauaaccauuaguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucagaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugaaaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuauggguuggucuuggccagacggugcugaguugccauuuaccauugacaaguaa

SEQ ID NO: 51216 - RNA, 1410 nt, Artificial Sequence
  neuraminidase__InfluenzaA__AEG79830
augaauccaaaccaaaagauaauaaccauuaguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51217 - RNA, 1410 nt, Artificial Sequence
  neuraminidase__InfluenzaA__AEG79836
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcugugcuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51218 - RNA, 1410 nt, Artificial Sequence
  neuraminidase__InfluenzaA__AEH59356
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuucugugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaagggaccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaucagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacagucuggacuagcgggagcagcauauccuuuugugguguaaacagugacacuguggguuggucuuggccagacggugcugaguugccauuuaccauugacaaguaa

SEQ ID NO: 51219 - RNA, 1410 nt, Artificial Sequence
  neuraminidase__InfluenzaA__AEH59360
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaaggccuugcuucuggguugaacuaaucagagggcgacccaaagagaacacaaucuggacuagcgggagcagcauauccuuuugugguguaaacagugacacuguggguuggucuuggccagacggugcugaguugccauuuaccaucgacaaguaa

SEQ ID NO: 51220 - RNA, 1410 nt, Artificial Sequence
  neuraminidase__InfluenzaA__AEH59364
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauucuucucucugcccuguuaguggaugggcuauauacaguaaagacaacaguauaagaaucgguuccaagggggauguguuugucauaagggaaccauucauaucaugcuccccuuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagaguccgaaugugcauguguaaauggcucuugcuuuacugugaugaccgauggaccaaaugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcgcgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51221 - RNA, 1410 nt, Artificial Sequence
  neuraminidase__InfluenzaA__AEH59366
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcugucccauugguggaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51222 - RNA, 1410 nt, Artificial Sequence
  neuraminidase__InfluenzaA__AEH59368
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcggguaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcugucccauuggugaaguucccucuccauacaacucaagauuugagucagucgcuuggucagcaagugcuugucaugauggcaucaacuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51223 - RNA, 1410 nt, Artificial Sequence
  neuraminidase__InfluenzaA__AEH59370
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggcccugcuaaaugacaaacauuccaauggaaccauuaaagacaggagcccauaucgaaccuuaaugagcuguccuauuggugaaguucccucuccauacaacucaagauuugagucagucgcuuggucagcaagugccugucaugauggcaucaauuggcuaacaauuggaaucucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccgagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51224 - RNA, 1410 nt, Artificial Sequence
  neuraminidase__InfluenzaA__AEH59372
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauucuucucucugcccuguuaguggaugggcuauauacaguaaagacaacaguauaagaaucgguuccaagggggauguguuugucauaagggaaccauucauaucaugcuccccuuuggaaugcagaaccuucuucuugacucaaggggccuugcuaaaugacaaacauuccaauggaaccauuaaagacaggagcccauaucgaacccuaaugagcugcccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagaguccgaaugugcauguguaaauggcucuugcuuuacugugaugaccgauggaccaaaugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcgcgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51225 - RNA, 1410 nt, Artificial Sequence; identical to SEQ ID NO: 51220
  neuraminidase__InfluenzaA__AEH59376

SEQ ID NO: 51226 - RNA, 1410 nt, Artificial Sequence
  neuraminidase__InfluenzaA__AEH59378
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccagauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaauggcguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51227 - RNA, 1410 nt, Artificial Sequence; identical to SEQ ID NO: 51220
  neuraminidase__InfluenzaA__AEH59382

SEQ ID NO: 51228 - RNA, 1410 nt, Artificial Sequence
  neuraminidase__InfluenzaA__AEH59384
augaauccaaaccaaaagauaauaaccauugguucagucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaaccuuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaggauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcggaaguuuuguucagcauccagaacuaacagggcuggauuguauaagaccuugcuucuggguugaacuaaucagagggcgacccaaagagaacacaaucuggacuagcggaagcagcauauccuuuugugguguaaacagugacacuguggguuggucuuggccagacggugcugaguugccauuuaccauugacaaguaa

SEQ ID NO: 51229 - RNA, 1410 nt, Artificial Sequence
  neuraminidase__InfluenzaA__AEH59386
augaauccaaaccaaaagauaauaaccauugguucggucuguaugacaauuggaauggcuaacuuaauauuacaaauuggaaacauaaucucaauauggauuagccacucaauucaaauugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccugucaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagaguccgaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51230 - RNA, 1410 nt, Artificial Sequence; identical to SEQ ID NO: 51220
  neuraminidase__InfluenzaA__AEH59388

SEQ ID NO: 51231 - RNA, 1410 nt, Artificial Sequence
  neuraminidase__InfluenzaA__AEH59390
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggcccugcuaaaugacaaacauuccaauggaaccauuaaagacaggagcccauaucgaaccuuaaugagcuguccuauuggugaaguucccucuccauacaacucaagauuugagucagucgcuuggucagcaagugccugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccgagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggacuaaaugaguggucaggauauagcgggaguuuuguucagcauccagaacuaacagggcuggauuguauaagaccuugcuucuggguugaacuaaucagagggcuacccaaagagaacacaaucuggacuagcgggagcagcauauccuuuugugguguaaacagugacacuguggguuggucuuggccagacggugcugaguugccauuuaccauugacaaguaa

SEQ ID NO: 51232 - RNA, 1410 nt, Artificial Sequence
  neuraminidase__InfluenzaA__AEH59392
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacaaucagugguuuccgugaaauuagcgggcaauucuucucucugcccuguuaguggaugggcuauauacaguaaagacaacaguauaagaaucgguuccaagggggauguguuugucauaagggaaccauucauaucaugcuccccuuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagaguccgaaugugcauguguaaauggcucuugcuuuacugugaugaccgauggaccaaaugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcgcgaaucgaccgugggugucuuucaaccagaaucuggaauaucagauaggauacauaugcagugggauuuucggggacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51233 - RNA, 1410 nt, Artificial Sequence; identical to SEQ ID NO: 51220
  neuraminidase__InfluenzaA__AEH59396

SEQ ID NO: 51234 - RNA, 1410 nt, Artificial Sequence
  neuraminidase__InfluenzaA__AEH59398
augaauccaaaccaaaagauaauaaccauugguucggucuguaugacaauuggaguggcuaacuuaauauuacaaauuggaaacauaaucucaauauggauuagccacucaauucaacuugggaaucaaaaucagauugagacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacuauauauugagaacacaagagucugaaugugcauguguaaaugguucuugcuuuaccauaaugaccgauggaccaagugauggacaggccucauacaagaucuucagaauagaaaagggaaagguagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucauaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51235 - RNA, 1410 nt, Artificial Sequence
  neuraminidase__InfluenzaA__AEH59400
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggcccugcuaaaugacaaacauuccaauggaaccauuaaagacaggagcccauaucgaaccuuaaugagcuguccuauuggugaaguucccucuccauacaacucaagauuugagucagucgcuuggucagcaagugccugucaugauggcaucaauuggcuaacaauuggaauuucuggcccagacaauggggcaguggcuguguuaaaguacaacggcauaauaacagacacuaucaagaguuggagaaacaauauauugagaacacaagaguccgaaugugcauguguaaauggcucuugcuuuacugugaugaccgauggaccaaaugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcgcgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaauugccauuuaccauugacaaguaa

SEQ ID NO: 51236 - RNA, 1410 nt, Artificial Sequence
  neuraminidase__InfluenzaA__AEH59402
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauucuucucucugcccuguuaguggaugggcuauauacaguaaagacaacaguauaagaaucgguuccaagggggauguguuugucauaagggaaccauucauaucaugcuccccuuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagaguccgaaugugcauguguaaauggcucuugcuuuacugugaugaccgauggaccaaaugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcgcgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugagacagacaauaacuucucaauaaagcaagauaucguaggaauaaaugaguggucaggauauagcgggaguuuuguucaacauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51237 - RNA, 1410 nt, Artificial Sequence
  neuraminidase__InfluenzaA__AEH59404
augaauccaaaccaaaagauaauaaccauugguucggccuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagccagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuagcucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51238 - RNA, 1410 nt, Artificial Sequence
  neuraminidase__InfluenzaA__AEH59406
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugaggacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuacuuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucguuuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauagaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51239 - RNA, 1410 nt, Artificial Sequence; identical to SEQ ID NO: 51098
  neuraminidase__InfluenzaA__AEH59408

SEQ ID NO: 51240 - RNA, 1410 nt, Artificial Sequence
  neuraminidase__InfluenzaA__AEH59412
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaaccuuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaggaguuggagaaacaauauauugagaacacaagagucugaaugugcauguguaaaugguucuugcuuuaccauaaugaccgauggaccaagugauggacaggccucauacaagaucuucagaauagaaaagggaaagauaaucaaaucagucgaaaugaaugccccuaauuaucacuaugaggaaugcuccuguuauccugauucuagugaaaucacaugugugugcagagauaacuggcauggcucgaaucgaccgugggugucuuucaaccagaaucuggaauaucagauaggauacauaugcagugggauuuucggagacaauccacgcccuaaugauaagacaggcaguugugguccaguauugucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51241 - RNA, 1410 nt, Artificial Sequence
  neuraminidase__InfluenzaA__AEH59416
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauucuucucucugcccuguuaguggaugggcuauauacaguaaagacaacaguauaagaaucgguuccaagggggauguguuugucauaagggaaccauucauaucaugcuccccuuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51242 - RNA, 1410 nt, Artificial Sequence
  neuraminidase__InfluenzaA__AEH59584
augaauccaaaccaaaagauaaucaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugagaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51243 - RNA, 1410 nt, Artificial Sequence
  neuraminidase__InfluenzaA__AEH59586
augaauccaaaccaaaagauaaucaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugcgguguaaacagugacacuguggguuggucuuggccagacggugcugaguugccauuuaccauugacaaguaa

SEQ ID NO: 51244 - RNA, 1410 nt, Artificial Sequence
  neuraminidase__InfluenzaA__AEH59588
augaauccaaaccaaaagauaaucaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguauuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugaggacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugaaaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugcgguguaaacagugacacuguggguuggucuuggccagacggugcugaguugccauuuaccauugacaaguaa

SEQ ID NO: 51245 - RNA, 1410 nt, Artificial Sequence
  neuraminidase__InfluenzaA__AEH59592
augaauccaaaccaaaagauaaucaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguauuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacgaucuggacuagcgggagcagcauauccuuuugcgguguaaacagugacacuguggguuggucuuggccagacggugcugaguugccauuuaccauugacaaguaa

SEQ ID NO: 51246 - RNA, 1410 nt, Artificial Sequence; identical to SEQ ID NO: 51245
  neuraminidase__InfluenzaA__AEH59594

SEQ ID NO: 51247 - RNA, 1410 nt, Artificial Sequence; identical to SEQ ID NO: 51243
  neuraminidase__InfluenzaA__AEH59596

SEQ ID NO: 51248 - RNA, 1410 nt, Artificial Sequence
  neuraminidase__InfluenzaA__AEH59598
augaauccaaaccaaaagauaaucaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51249 - RNA, 1410 nt, Artificial Sequence
  neuraminidase__InfluenzaA__AEH59600
augaauccaaaccaaaagauaaucaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacgguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacugaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51250 - RNA, 1410 nt, Artificial Sequence
  neuraminidase__InfluenzaA__AEH59602
augaauccaaaccaaaagauaaucaccauugguucggucuguaugacaauuggaauggcuaacuuaauauuacaaauuggaaacauaaucucaauauggauuagccacucaauucaacuugggagucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51251 - RNA, 1410 nt, Artificial Sequence; identical to SEQ ID NO: 51245
  neuraminidase__InfluenzaA__AEH59606

SEQ ID NO: 51252 - RNA, 1410 nt, Artificial Sequence
  neuraminidase__InfluenzaA__AEH59616
augaauccaaaccaaaagauaaucaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51253 - RNA, 1410 nt, Artificial Sequence; identical to SEQ ID NO: 51243
  neuraminidase__InfluenzaA__AEH59626

SEQ ID NO: 51254 - RNA, 1413 nt, Artificial Sequence; identical to SEQ ID NO: 50451
  neuraminidase__InfluenzaA__AEH77262

SEQ ID NO: 51255 - RNA, 1410 nt, Artificial Sequence
  neuraminidase__InfluenzaA__AEH77273
augaauccaaaccaaaagauaauaaccauugguucggucuguaugacaauuggaauggcuaacuuaauauuacaaauuggaaacauaaccucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51256 - RNA, 1410 nt, Artificial Sequence
  neuraminidase__InfluenzaA__AEH77282
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggugacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucguugaggaggggaaaaucguucauauuagcacauugucaggaagugcucagcaugucgaggaguguuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 51257 - RNA, 1410 nt, Artificial Sequence; identical to SEQ ID NO: 48630
  neuraminidase__InfluenzaA__AEI29218

SEQ ID NO: 51258 - RNA, 1410 nt, Artificial Sequence; identical to SEQ ID NO: 48609
  neuraminidase__InfluenzaA__AEI29228

SEQ ID NO: 51259 - RNA, 1410 nt, Artificial Sequence; identical to SEQ ID NO: 44641
  neuraminidase__InfluenzaA__AEI54350

SEQ ID NO: 51260 - RNA, 1410 nt, Artificial Sequence; identical to SEQ ID NO: 44790
  neuraminidase__InfluenzaA__AEI54361

SEQ ID NO: 51261 - RNA, 1410 nt, Artificial Sequence
  neuraminidase__InfluenzaA__AEI54372
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugacacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51262 - RNA, 1410 nt, Artificial Sequence; identical to SEQ ID NO: 45095
  neuraminidase__InfluenzaA__AEI54383

SEQ ID NO: 51263 - RNA, 1410 nt, Artificial Sequence; identical to SEQ ID NO: 51182
  neuraminidase__InfluenzaA__AEI54394

SEQ ID NO: 51264 - RNA, 1410 nt, Artificial Sequence
  neuraminidase__InfluenzaA__AEI54416
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaagagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51265 - RNA, 1410 nt, Artificial Sequence; identical to SEQ ID NO: 51208
  neuraminidase__InfluenzaA__AEI54427

SEQ ID NO: 51266 - RNA, 1410 nt, Artificial Sequence
  neuraminidase__InfluenzaA__AEI54438
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuauaggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaacuuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuagaggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51267 - RNA, 1410 nt, Artificial Sequence
  neuraminidase__InfluenzaA__AEI54449
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuauaggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaacuuucaaagucauugaaggcugguccaacccuaaguccaaauugcagauaaauaggcaagucauaguugacagagguaauagguccgguuauucugguauuuuuucuguugaaggcaaaagcugcaucaaucggugcuuuuauguggaguugauuagaggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51268 - RNA, 1410 nt, Artificial Sequence
  neuraminidase__InfluenzaA__AEI54460
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51269 - RNA, 1410 nt, Artificial Sequence
  neuraminidase__InfluenzaA__AEI54471
augaauccaaaucaaaagauaauaacgauuggcucuguuucucucaccauuuccacaauaugcuucuucaugcaaauugccgucuugauaacuacuguaacauugcauuucaagcaauauaaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaaugugacauuacgggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucgaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaauuguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagagguaauaggucagguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51270 - RNA, 1410 nt, Artificial Sequence
  neuraminidase__InfluenzaA__AEI54482
augaauccaaaucaaaagauaauaacgauuggcucuguuucucucaccauuuccacaauaugcuucuucaugcaaauugccaucuugauaacuacuguaacauugcauuucaagcaauauaaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaaugugacauuacgggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucgaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaauuguucauacuagcacauugucaggaagugcucagcauguagaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51271 - RNA, 1410 nt, Artificial Sequence
  neuraminidase__InfluenzaA__AEI54493
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgaaacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugucuauauaa

SEQ ID NO: 51272 - RNA, 1410 nt, Artificial Sequence
  neuraminidase__InfluenzaA__AEI54504
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuauaggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaacuuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51273 - RNA, 1410 nt, Artificial Sequence
  neuraminidase__InfluenzaA__AEI59982
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagagagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcgucuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcguuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaaccauaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51274 - RNA, 1413 nt, Artificial Sequence; identical to SEQ ID NO: 50440
  neuraminidase__InfluenzaA__AEI59993

SEQ ID NO: 51275 - RNA, 1413 nt, Artificial Sequence; identical to SEQ ID NO: 50436
  neuraminidase__InfluenzaA__AEI60004

SEQ ID NO: 51276 - RNA, 1410 nt, Artificial Sequence
  neuraminidase__InfluenzaA__AEI60015
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuagacuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguucccuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcgucuguaucaauggaacuuguacaguaguaaugacugaugggagugcuucaggaaaagcugauacuaaaauauuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguggccauuguuuggauccuaacaaugaagaaggugguaauggagugaaaggcugggccuuugaugauggaaaugacguguggaugggaagaacgaucagcgagaagucacgcuuaggguaugaaaccuucaaagucauugaaggcugguccaaccauaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51277 - RNA, 1410 nt, Artificial Sequence; identical to SEQ ID NO: 49752
  neuraminidase__InfluenzaA__AEI60026

SEQ ID NO: 51278 - RNA, 1410 nt, Artificial Sequence
  neuraminidase__InfluenzaA__AEI60037
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaggugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcgucuguaucaauggaacuuguacaguaguaaugacugaugggagugcuucaggaaaagcugauacuaaaauacuauucauugaggaggggaaaaucguucauacuagcacauuaucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaagaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaaccauaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51279 - RNA, 1410 nt, Artificial Sequence
  neuraminidase__InfluenzaA__AEI60048
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugcaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51280 - RNA, 1410 nt, Artificial Sequence
  neuraminidase__InfluenzaA__AEI60089
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51281 - RNA, 1410 nt, Artificial Sequence
  neuraminidase__InfluenzaA__AEI60099
augaauccaaaccaaaagauaauaaccauugguucggucuguaugacaauuggaauggcuaacuuaauauuacaaauuggaaacauaaucucaauauggauuagccacucaauucaacuugggaaucaaaaucaaauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51282 - RNA, 1410 nt, Artificial Sequence
  neuraminidase__InfluenzaA__AEI60111
augaacccaaaucaaaagauaauaacaauuggcucuauuucucuuaccauugccacaauaugcuuccuuaugcaaauugccauccugguaacuacuguaacauugcauuucaagcaguauaaaugcaacuccccuccaaacaaccgaguaaugcugugugaaccaacaauaauagaaagaaacauaacagagauaguauaucugaccaacaccaccauagagaaggaaauaugccccaaacuagcagaauacaggaauuggucaaagccacaauguaacauuaaaggauuugcaccuuuuucuaaggacaauucgauucggcuuuccgcugguggggacaucugggugacaagagaaccuuauguaucaugcgauccggauaaguguuaucaauuugcccuuggucagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucaugauggaaaagcauggcugcauguuuguauaacuggagacgaugaaaaugcaacugcuagcuucauuuacaaugggaggcuuguagauaguauugggucaugguccaaaaaaauacucagaacccaggagucggaaugcguuuguaucaauggaacuuguacaguaguaaugacagacgggagcgcuucaggaaaggcugauacuaaaauacuauucauugaagaggggaagaucguucauauuagcacauugucaggaagugcucagcaugucgaggagugcuccuguuauccucgauauccuggugucagauguguuugcagagacaacuggaaaggcuccaauaggcccaucguagauauaaauguaagggauuauagcauuguuuccaguuaugugugcucaggacuuguuggagacacacccagaaaaaacgacagcuucagcaguagccacugccuagauccuaacaaugaggaagguggucauggagugaaaggaugggccuuugaugauggaaaugacguguggaugggaagaacgaucagcgagaaguuacgcucagguuaugaaaccuucaaagucaucgaaggcugguccaaaccuaacuccaaauugcaaguaaauaggcaagucauaguugaaagagguaacagaucagguuauucugguauuuucuccguugaagguaaaagcugcaucaaucggugcuuuuauguggaguugauaaggggaaggaaagaggaaacuaaagucugguggaccucaaacaguauuguuguguuuuguggcaccucagguacauauggaacaggcucauggccugauggggcggauaucaauaucaugccuauauaa

SEQ ID NO: 51283 - RNA, 1410 nt, Artificial Sequence
  neuraminidase__InfluenzaA__AEI73669
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugccccguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuuguggugugaacagugacacuguggguuggucuuggccagacggugcugaguugccauuuaccauugacaaguaa

SEQ ID NO: 51284 - RNA, 1410 nt, Artificial Sequence
  neuraminidase__InfluenzaA__AEI86727
augaauccaaaccaaaagauaauaaccauugguucggucuguauaacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucgugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaaaauuugagucagucgcuuggucagcaagugcuugucaugauggcaucaguuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcggaaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51285 - RNA, 1410 nt, Artificial Sequence
  neuraminidase__InfluenzaA__AEI86737
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaaaacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucugguccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagguagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucaaauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggaccgggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51286 - RNA, 1410 nt, Artificial Sequence
  neuraminidase__InfluenzaA__AEI86757
augaauccaaaccaaaagauaauaaccauugguucggucuguauaacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaguuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuauuucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51287 - RNA, 1410 nt, Artificial Sequence
  neuraminidase__InfluenzaA__AEI86767
augaauccaaaccaaaagauaauaaccauugguucggucuguauaacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaguuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccauaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51288 - RNA, 1410 nt, Artificial Sequence; identical to SEQ ID NO: 51287
  neuraminidase__InfluenzaA__AEI86777

SEQ ID NO: 51289 - RNA, 1410 nt, Artificial Sequence
  neuraminidase__InfluenzaA__AEI86787
augaauccaaaccagaagauaauaaccauugguucggucuguaugacaauuggaauggcuaacuuaauguuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagggggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51290 - RNA, 1410 nt, Artificial Sequence
  neuraminidase__InfluenzaA__AEI86797
augaauccaaaccaaaagauaauaaccauugguucggucuguauaacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucgugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaguuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcggaaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51291 - RNA, 1410 nt, Artificial Sequence
  neuraminidase__InfluenzaA__AEI86807
augaauccaaaccagaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaccgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuaguaaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaucauugacaaguaa

SEQ ID NO: 51292 - RNA, 1410 nt, Artificial Sequence; identical to SEQ ID NO: 51287
  neuraminidase__InfluenzaA__AEI86817

SEQ ID NO: 51293 - RNA, 1410 nt, Artificial Sequence
  neuraminidase__InfluenzaA__AEI86827
augaauccaaaccaaaagauaauaaccauugguucggucuguauaacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaguuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgauggaccaagugauggacaggccucauacaaaaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccauaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcacuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcugaauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51294 - RNA, 1410 nt, Artificial Sequence
  neuraminidase__InfluenzaA__AEI86837
augaauccaaaccaaaagauaauaaccauugguucggucuguauaacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaguuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcggaaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51295 - RNA, 1410 nt, Artificial Sequence; identical to SEQ ID NO: 51094
  neuraminidase__InfluenzaA__AEI86847

SEQ ID NO: 51296 - RNA, 1410 nt, Artificial Sequence
  neuraminidase__InfluenzaA__AEI86867
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuggcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacagaagcccauaucgaacccuaaugagcuguccuauuggugaaguucccucuccauacaacucaaaauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccggaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51297 - RNA, 1410 nt, Artificial Sequence; identical to SEQ ID NO: 51294
  neuraminidase__InfluenzaA__AEI86887

SEQ ID NO: 51298 - RNA, 1410 nt, Artificial Sequence; identical to SEQ ID NO: 51294
  neuraminidase__InfluenzaA__AEI86897

SEQ ID NO: 51299 - RNA, 1410 nt, Artificial Sequence
  neuraminidase__InfluenzaA__AEI86907
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacauacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51300 - RNA, 1410 nt, Artificial Sequence
  neuraminidase__InfluenzaA__AEI86917
augaauccaaaccaaaagauaauaaccauugguucgaucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagcgggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51301 - RNA, 1410 nt, Artificial Sequence
  neuraminidase__InfluenzaA__AEI86927
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuuguaauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51302 - RNA, 1410 nt, Artificial Sequence; identical to SEQ ID NO: 51287
  neuraminidase__InfluenzaA__AEI86937

SEQ ID NO: 51303 - RNA, 1410 nt, Artificial Sequence
  neuraminidase__InfluenzaA__AEI86947
augaauccaaaccaaaagauaauaaccauugguucggucuguaugacaauuggaauggcuaacuuaauauuacaaauuggaaacauaaucucaauauggauuagccacucaauucaacuugggaauaaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51304 - RNA, 1410 nt, Artificial Sequence
  neuraminidase__InfluenzaA__AEI86967
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggaugcguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51305 - RNA, 1410 nt, Artificial Sequence
  neuraminidase__InfluenzaA__AEI86977
augaauccaaaccaaaagauaauaaccauugguucggucuguaugacaauuggaauggcuaacuuaauauuacaaauuggaaacauaaucucaauauggauuagccacucaauucaacuugggaaucaaaaucagauuggaacaugcaaucagagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauacugagaacacaagagucugaauguacauguguaaaugguucuugcuuuacuguaaugaccgauggaccaagugauggacaggccucauacaagaucuucaaaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggggacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51306 - RNA, 1410 nt, Artificial Sequence
  neuraminidase__InfluenzaA__AEI86997
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaggaguggucaggauauagcgggaguuuuguucagcauccagaacuaacagggcuggauuguauaagaccuugcuucuggguugaacuaaucagagggcgacccaaagagaacacaaucuggacuagcgggagcaucauauccuuuugugguguaaacagugacacuguggguuggucuuggccagacggugcugaguugccauuuaccauugacaaguaa

SEQ ID NO: 51307 - RNA, 1410 nt, Artificial Sequence
  neuraminidase__InfluenzaA__AEI87007
augaauccaaaccaaaagauaauaaccauugguucggucuguauaacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcuccuccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaguuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51308 - RNA, 1410 nt, Artificial Sequence
  neuraminidase__InfluenzaA__AEI87017
augaauccaaaccagaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacggugacacuggggguuggucuuggccagacggugcugaguugccauuuaccauugacaaguaa

SEQ ID NO: 51309 - RNA, 1410 nt, Artificial Sequence
  neuraminidase__InfluenzaA__AEI87027
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51310 - RNA, 1410 nt, Artificial Sequence
  neuraminidase__InfluenzaA__AEI87037
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaauuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaggaguggucaggauauagcgggaguuuuguucagcauccagaacuaacagggcuggauuguauaagaccuugcuucuggguugaacuaaucagagggcgacccaaagagaacacaaucuggacuagcgggagcaucauauccuuuugugguguaaacagugacacuguggguuggucuuggccagacggugcugaguugccauuuaccauugacaaguaa

SEQ ID NO: 51311 - RNA, 1410 nt, Artificial Sequence
  neuraminidase__InfluenzaA__AEI87047
augaauccaaaccaaaagauaauaaccauugguucggucuguauaacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaguuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51312 - RNA, 1410 nt, Artificial Sequence
  neuraminidase__InfluenzaA__AEI87057
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51313 - RNA, 1410 nt, Artificial Sequence; identical to SEQ ID NO: 51094
  neuraminidase__InfluenzaA__AEI87067

SEQ ID NO: 51314 - RNA, 1410 nt, Artificial Sequence
  neuraminidase__InfluenzaA__AEI87077
augaauccaaaccaaaagauaauaaccauugguucgaucuguaugacaauuggaauggcuaacuuaauauuacaaauuggaaacauaaucucaauauggauuagccacucaauucaauuugggaaucaaaaucagauuggaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagcgggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51315 - RNA, 1410 nt, Artificial Sequence
  neuraminidase__InfluenzaA__AEI87087
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuauuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaggaguggucaggauauagcgggaguuuuguucagcauccagaacuaacagggcuggauuguauaagaccuugcuucuggguugaacuaaucagagggcgacccaaagagaacacaaucuggacuagcgggagcaucauauccuuuuguaguguaaacagugacacuguggguuggucuuggccagacggugcugaguugccauuuaccauugacaaguaa

SEQ ID NO: 51316 - RNA, 1410 nt, Artificial Sequence; identical to SEQ ID NO: 51287
  neuraminidase__InfluenzaA__AEI87097

SEQ ID NO: 51317 - RNA, 1410 nt, Artificial Sequence; identical to SEQ ID NO: 51287
  neuraminidase__InfluenzaA__AEI87107

SEQ ID NO: 51318 - RNA, 1413 nt, Artificial Sequence
  neuraminidase__InfluenzaA__AEI91968
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccugacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauagggagaaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaaaaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 51319 - RNA, 1410 nt, Artificial Sequence
  neuraminidase__InfluenzaA__AEI91983
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcagcugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51320 - RNA, 1410 nt, Artificial Sequence; identical to SEQ ID NO: 49728
  neuraminidase__InfluenzaA__AEI91984

SEQ ID NO: 51321 - RNA, 1410 nt, Artificial Sequence
  neuraminidase__InfluenzaA__AEI92004
augaauccaaaccaaaagauaauaaccauugguucggucugcaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcauauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51322 - RNA, 1413 nt, Artificial Sequence
  neuraminidase__InfluenzaA__AEI92023
augaacccaaaucaaaagauaauaaccauuggaucaaucaguauagcaaucggaauaauuagucuaauguugcaaauaggaaauauuauuucaauaugggcuagucauucaauccaaacuggaagucaaaacaacacuggaauaugcaaccaaaaaaucaucacauaugaaaacagcaccugggugaaucacacauauguuaauauuaacaacacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaacauuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgcuucauacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggaacaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 51323 - RNA, 1410 nt, Artificial Sequence
  neuraminidase__InfluenzaA__AEJ10403
augaauccaaaccaaaagauaauaaccauugguucggucuguauaacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaguuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucggcuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucgauaaagcaagauaucguaggaauaaaugaguggucaggauauagcggaaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51324 - RNA, 1410 nt, Artificial Sequence
  neuraminidase__InfluenzaA__AEJ10413
augaauccaaaccaaaagauaauaaccauugguucggucuguauaacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucgugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaguuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgauggaccaagugauggacaagccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcggaaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51325 - RNA, 1410 nt, Artificial Sequence
  neuraminidase__InfluenzaA__AEJ10423
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacggcuuugagaugauuugggauccgaacggauggacugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51326 - RNA, 1410 nt, Artificial Sequence
  neuraminidase__InfluenzaA__AEJ10433
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucggauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucauaggaauaaaugaguggucaggauauagcgggaguuuuguucagcauccagaacuaacagggcuggauuguauaagaccuugcuucuggguugaacuaaucagagggcggcccaaagagaacacaaucuggacuagcgggagcagcauauccuuuugugguguaaacaguggcacuguggguuggucuuggccagacggugcugaguugccauuuaccauugacaaguaa

SEQ ID NO: 51327 - RNA, 1410 nt, Artificial Sequence; identical to SEQ ID NO: 51094
  neuraminidase__InfluenzaA__AEJ10443

SEQ ID NO: 51328 - RNA, 1410 nt, Artificial Sequence; identical to SEQ ID NO: 51098
  neuraminidase__InfluenzaA__AEJ10453

SEQ ID NO: 51329 - RNA, 1410 nt, Artificial Sequence
  neuraminidase__InfluenzaA__AEJ10463
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51330 - RNA, 1410 nt, Artificial Sequence
  neuraminidase__InfluenzaA__AEJ10473
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaaaacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaacuuucuucuugacucaaggggccuugcugaaugacaaacauuccaauggaaccauuaaagacaggagcccauaucgaacccuaaugagcuguccuauuggugaaguucccucuccauacaauucaagauuugagucagucgcuuggucagcaagugcuugccaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggaccgggacagacaauaaauucucaauaaagcaagauaucguaggaauaaaugaguggucaggauauagcgggaguuuuguucagcauccagaacuaacagggcugaauuguauaagaccuugcuucuggguugaacuaaucagagggcgacccaaggagaacacaaucuggacuagcgggagcagcauauccuuuugugguguaaacagugacacuguggguuggucuuggccagacggugcugaguugccauuuaccauugacaaguaa

SEQ ID NO: 51331 - RNA, 1410 nt, Artificial Sequence
  neuraminidase__InfluenzaA__AEJ10503
augaauccaaaccaaaagauaauaaccauugguucggucuguaugacaauuggaauggcuaacuuaauauuacaaauuggaaacauaaucucaauauggauuagccacucaauccaacuugggaaucaaagucagauugaaacaugcaaucaaagcgucauuacuuaugaaaacaacacuuggguaaaucagacauauguuaacaucagcaacaccaacuuugcugcuggacagucagugguuucagugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauauaguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51332 - RNA, 1410 nt, Artificial Sequence; identical to SEQ ID NO: 47242
  neuraminidase__InfluenzaA__AEJ10523

SEQ ID NO: 51333 - RNA, 1410 nt, Artificial Sequence; identical to SEQ ID NO: 47242
  neuraminidase__InfluenzaA__AEJ10533

SEQ ID NO: 51334 - RNA, 1410 nt, Artificial Sequence; identical to SEQ ID NO: 47242
  neuraminidase__InfluenzaA__AEJ10543

SEQ ID NO: 51335 - RNA, 1410 nt, Artificial Sequence; identical to SEQ ID NO: 47242
  neuraminidase__InfluenzaA__AEJ10553

SEQ ID NO: 51336 - RNA, 1410 nt, Artificial Sequence
  neuraminidase__InfluenzaA__AEJ10563
augaauccaaaccaaaagauaauaaccauugguucggucuguaugacaauuggaauggcuaacuuaauauuacaaauugggaacauaaucucaauauggauuagccacucaauucaacuugggaauaaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcuccccccuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaggauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaacggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagugggagcagcauauccuuuugugguguaaacagugacacuguggguuggucuuggccagacggugcugaguugccauuuaccauugacaaguaa

SEQ ID NO: 51337 - RNA, 1410 nt, Artificial Sequence; identical to SEQ ID NO: 51336
  neuraminidase__InfluenzaA__AEJ10573

SEQ ID NO: 51338 - RNA, 1410 nt, Artificial Sequence; identical to SEQ ID NO: 51336
  neuraminidase__InfluenzaA__AEJ10583

SEQ ID NO: 51339 - RNA, 1410 nt, Artificial Sequence
  neuraminidase__InfluenzaA__AEJ36305
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacagaagcccauaucgaacccuaaugagcuguccuauuggugaaguucccucuccauacaacucaagauuugagucagucgcuuggucagcaagugcuugucaugauggcaucaacuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgagaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcacuaguucaagaaacgguuuugagaugauuugggauccgaacggauggacugggacagacaauagcuucucaauaaagcaagauaucguaggaauaaaugaguggucaggauauagcgggaguuuuguucagcauccagaacuaacagggcuggauuguauaagaccuugcuucuggguugaacuaaucagagggcgaccuaaagagaacacaaucuggacuagcgggagcagcauauccuuuugugguguaaacagugacacuguggguuggucuuggccagacggugcugaguugccauuuaccauugacaaguaa

SEQ ID NO: 51340 - RNA, 1410 nt, Artificial Sequence
  neuraminidase__InfluenzaA__AEJ37856
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccguacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggcuucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagugggagcagcauauccuuuugugguguaaacagugacacuguggguuggucuuggccagacggugcugaguugccauuuaccauugacaaguaa

SEQ ID NO: 51341 - RNA, 1410 nt, Artificial Sequence
  neuraminidase__InfluenzaA__AEJ37866
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggagugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51342 - RNA, 1410 nt, Artificial Sequence
  neuraminidase__InfluenzaA__AEJ37876
augaauccaaaccaaaagauaauaaccauugguucggucuguaugacaauugggauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggagugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggagcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51343 - RNA, 1410 nt, Artificial Sequence; identical to SEQ ID NO: 51311
  neuraminidase__InfluenzaA__AEJ37886

SEQ ID NO: 51344 - RNA, 1410 nt, Artificial Sequence
  neuraminidase__InfluenzaA__AEJ37896
augaauccaaaccaaaagauaauaaccauugguucggucuguauaacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaguuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgauggaccaagugauggacaggccucauacaagaucuucagaauagaaaagggaaggauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51345 - RNA, 1410 nt, Artificial Sequence; identical to SEQ ID NO: 51311
  neuraminidase__InfluenzaA__AEJ37906

SEQ ID NO: 51346 - RNA, 1410 nt, Artificial Sequence; identical to SEQ ID NO: 51311
  neuraminidase__InfluenzaA__AEJ37916

SEQ ID NO: 51347 - RNA, 1410 nt, Artificial Sequence; identical to SEQ ID NO: 51311
  neuraminidase__InfluenzaA__AEJ37926

SEQ ID NO: 51348 - RNA, 1410 nt, Artificial Sequence
  neuraminidase__InfluenzaA__AEJ37936
augaauccaaaucaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggagugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaaaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51349 - RNA, 1410 nt, Artificial Sequence
  neuraminidase__InfluenzaA__AEJ37946
augaauccaaaccaaaagauaauaaccauugguucggucuguaugacaauugggauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggagugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggagcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugagcuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51350 - RNA, 1410 nt, Artificial Sequence; identical to SEQ ID NO: 51311
  neuraminidase__InfluenzaA__AEJ37956

SEQ ID NO: 51351 - RNA, 1410 nt, Artificial Sequence
  neuraminidase__InfluenzaA__AEJ37966
augaauccaaaccaaaagauaauaaccauugguucggucuguauaacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaguuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauuaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51352 - RNA, 1410 nt, Artificial Sequence
  neuraminidase__InfluenzaA__AEJ37976
augaauccaaaccaaaagauaauaaccauugguucggucuguaugacaauugggauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggagugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggagcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauuaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51353 - RNA, 1410 nt, Artificial Sequence; identical to SEQ ID NO: 51311
  neuraminidase__InfluenzaA__AEJ37986

SEQ ID NO: 51354 - RNA, 1410 nt, Artificial Sequence; identical to SEQ ID NO: 49914
  neuraminidase__InfluenzaA__AEK21372

SEQ ID NO: 51355 - RNA, 1413 nt, Artificial Sequence
  neuraminidase__InfluenzaA__AEK21383
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuugcucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguugacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuacgaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguugauggagcagacggaguaaaaggguuuucauacaaauaugguaaugguguuuggauaggaaggaccaaaaguaacagacuuagaaagggguuugagaugauuugggauccuaauggguggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 51356 - RNA, 1410 nt, Artificial Sequence
  neuraminidase__InfluenzaA__AEK21399
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacauuagcaacaccaacuuugcugcuggacagucagugguuuccgugaaauuagcgggcaauuccucucuuugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccuccccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaaaaucuucaaaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggggacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51357 - RNA, 1410 nt, Artificial Sequence
  neuraminidase__InfluenzaA__AEK21409
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacaaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51358 - RNA, 1410 nt, Artificial Sequence; identical to SEQ ID NO: 51301
  neuraminidase__InfluenzaA__AEK21419

SEQ ID NO: 51359 - RNA, 1410 nt, Artificial Sequence; identical to SEQ ID NO: 51311
  neuraminidase__InfluenzaA__AEK21429

SEQ ID NO: 51360 - RNA, 1410 nt, Artificial Sequence
  neuraminidase__InfluenzaA__AEK21439
augaauccaaaccaaaagauaauaaccauugguucggucuguaugacaauugggauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggagugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggagcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaaaaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51361 - RNA, 1410 nt, Artificial Sequence
  neuraminidase__InfluenzaA__AEK21449
augaauccaaaccaaaagauaauaaccauugguucggucuguauaacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccuccccauacaacucaagauuugagucagucgcuuggucagcaagugcuugucaugauggcaucaguuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51362 - RNA, 1410 nt, Artificial Sequence
  neuraminidase__InfluenzaA__AEK21459
augaauccaaaucaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcguuauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggagugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaaaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51363 - RNA, 1410 nt, Artificial Sequence; identical to SEQ ID NO: 51311
  neuraminidase__InfluenzaA__AEK21469

SEQ ID NO: 51364 - RNA, 1410 nt, Artificial Sequence; identical to SEQ ID NO: 51311
  neuraminidase__InfluenzaA__AEK21479

SEQ ID NO: 51365 - RNA, 1410 nt, Artificial Sequence; identical to SEQ ID NO: 51342
  neuraminidase__InfluenzaA__AEK21489

SEQ ID NO: 51366 - RNA, 1410 nt, Artificial Sequence
  neuraminidase__InfluenzaA__AEK28776
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugguaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucgaugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51367 - RNA, 1410 nt, Artificial Sequence
  neuraminidase__InfluenzaA__AEK28787
augaacccaaaucaaaagauaauaacgauuggcucuguuucucucaccauuuccacaauaugcuucuucaugcaaauugccaucuugauaacuacuguaacauugcauuucaagcaauaugaauucuacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuccaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaagaggggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcagaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51368 - RNA, 1410 nt, Artificial Sequence
  neuraminidase__InfluenzaA__AEK28798
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaccugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggacgauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggaaugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguucggauccuaacaaugaagaagguggucauggggugaaaggcugggccuuugaugauggaaaugacguguggaugggaagaacgaucagcgagaagucacgcuuaggauaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggauaucaaucucaugccuauauaa

SEQ ID NO: 51369 - RNA, 1410 nt, Artificial Sequence
  neuraminidase__InfluenzaA__AEK28809
augaauccaaaucaaaagauaauaacaauuggcucuguuucucucaccauuuccacaauaugcuucuucaugcaaauugccaucuugauaacuacugugacagugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacaaaguacgugauaggaccccuuaucggacccuauugaugaaugaguuagguguuccuuuucaucuggggaccaagcaagugugcauagcaugguccagcucaaguugucacgaugggaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauaccagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaggaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51370 - RNA, 1410 nt, Artificial Sequence
  neuraminidase__InfluenzaA__AEK28819
augaauccaaaucaaaagauaauaacgauuggcucuguuucucucaccauuuccacaauaugcuucuucaugcaaauugccaucuugauaacuacuguaacauugcauuucaagcaauaugaauucaacuaccccccaaacaaccaagugaugcugugugaaccaacaauaauagaaagaaacauaacagagauaguguaucugaccaacaccaccauagagaaggagauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugagaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51371 - RNA, 1410 nt, Artificial Sequence
  neuraminidase__InfluenzaA__AEK28830
augaauccaaaucaaaagauaauaacuauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaccuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugguaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguccauacuagcacauugucaggaagugcucagcaugucgaggagugcuccugcuauccucgauauccuggugucagaugugucugcagagacaacuggaaaggauccaauaggcccaucguagauauaaacauaaaggaucauagcauuguuuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51372 - RNA, 1410 nt, Artificial Sequence
  neuraminidase__InfluenzaA__AEK28841
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacaguaaacaacgugcauucaaauaacacaguacgugguaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguggauaguguuguuucaugguccaaagaaauccucaggacccaggagucagaaugcgucuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaacuuucaaagucauugaaggcugguccaaccauaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51373 - RNA, 1410 nt, Artificial Sequence
  neuraminidase__InfluenzaA__AEK28852
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaaaaaacauaacagagauaguguaucugaccaacaccaccauagagaaggaaauaugccccaaacuagcagaauacagaaauuggucaaagccacaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacagaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaccauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51374 - RNA, 1410 nt, Artificial Sequence; identical to SEQ ID NO: 49746
  neuraminidase__InfluenzaA__AEK28863

SEQ ID NO: 51375 - RNA, 1410 nt, Artificial Sequence
  neuraminidase__InfluenzaA__AEK28874
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacaaaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcgucuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaaccauaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51376 - RNA, 1410 nt, Artificial Sequence
  neuraminidase__InfluenzaA__AEK28885
augaauccaaaucaaaagauaauaacgauuggcucuguuucucucaccauuuccacaauaugcuucuucaugcaaauugccaucuugauaacuacugugacauugcauuucaagcaauaugaauucaaccuccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccguuuuccaaggacaauucgauuaggcuuuccgcugguggggacaucuggguaacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51377 - RNA, 1410 nt, Artificial Sequence
  neuraminidase__InfluenzaA__AEK28896
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaaaaaacauaacagagauaguguaucugaccaacaccaccauagagaaggaaauaugccccaaacuagcagaauacagaaauuggucaaagccacaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaccauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51378 - RNA, 1410 nt, Artificial Sequence
  neuraminidase__InfluenzaA__AEK28907
augaauccaaaucaaaagauaauaacgauuggcucuguuucucucaccauuuccacaauaugcuucuucaugcaaauugccaucuugauaacuacuguaacauugcauuucaagcaauaugaauucaacuccccuccaaacaaccaagugaugcugugugaaccaacaauaauagaaaaaaacauaacagagauaguguaucugaccaacaccaccauagagaaggaaauaugccccagacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuugggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51379 - RNA, 1410 nt, Artificial Sequence
  neuraminidase__InfluenzaA__AEK28918
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagagccuuaugugucaugcgauccugacaaguguuaucaauuugcccucggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51380 - RNA, 1410 nt, Artificial Sequence; identical to SEQ ID NO: 49718
  neuraminidase__InfluenzaA__AEK28929

SEQ ID NO: 51381 - RNA, 1410 nt, Artificial Sequence
  neuraminidase__InfluenzaA__AEK28951
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaauuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcgucuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcucaggguaugaaaccuucaaagucauugaaggcugguccaaccauaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagccuuguggaccucaaacaguauuguuguguuuuguggcaccucagguacauauggaacaggcucauggccugauggggcggaccucaaucucaugccuauauaa

SEQ ID NO: 51382 - RNA, 1410 nt, Artificial Sequence
  neuraminidase__InfluenzaA__AEK28962
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauccgaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauacucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauuguuuccaguuauguguguucaggacuuguuggagacacacccagaaaaaacgacagcuccagcagcagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51383 - RNA, 1410 nt, Artificial Sequence
  neuraminidase__InfluenzaA__AEK28973
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcgucuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaacuuucaaagucauugaaggcugguccaaccauaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaauuucaugccuauauaa

SEQ ID NO: 51384 - RNA, 1410 nt, Artificial Sequence
  neuraminidase__InfluenzaA__AEK28984
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgguuaggcuuuccgcugguggggacaucugggugacaagagaaccuuaugugucaugcgauccugacaaguguuaucaauuugcccuuggacagggaacaacacuaaacaacgugcauucgaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagagugcguuuguaucaauggaacuuguacaguaguaaugacugaugggagugcuucaggaaaagcugauacuaaaauacuauucauugaggaggggaaaaucguucauaccagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaaguuuuguggaccucaaacaguauuguuguguuuuguggcaccucagguacauauggaacaggcucauggccugauggggcggacaucaaucucaugccuauauaa

SEQ ID NO: 51385 - RNA, 1410 nt, Artificial Sequence; identical to SEQ ID NO: 51384
  neuraminidase__InfluenzaA__AEK28995

SEQ ID NO: 51386 - RNA, 1410 nt, Artificial Sequence
  neuraminidase__InfluenzaA__AEK29006
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51387 - RNA, 1410 nt, Artificial Sequence
  neuraminidase__InfluenzaA__AEK29028
augaauccaaaccaaaagauaauaacgauuggcucuguuucccucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacaaggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggacgauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucaucgaggaggggaaaaucguucauacuagcacauugucaggaagugcucaacaugucgaggagugcuccugcuauccucgauauccuggugucagaugugucugcagagacaacuggaaaggcuccaauaggcccaucguagauauaaacaugaaggaucauagcauuguuuccaguuauguguguucaggacuuguuggagacacacccagaaaaaacgacagcuccagcaguagccauuguuuugauccuaacgaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaaguauuguggaccucaaacaguauuguuguguuuuguggcaccucagguacauauggaacaggcucauggccugauggggcggacaucaaucucaugccuauauaa

SEQ ID NO: 51388 - RNA, 1410 nt, Artificial Sequence
  neuraminidase__InfluenzaA__AEK29050
augaauccaaaucaaaagauaauaacuauuggcucuguuucucucaccauuuccacaauaugcuucuucaugcaaauugccaucuugauaacuacuguaacauugcauuucaagcaauaugaauucaacccccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguugucucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51389 - RNA, 1410 nt, Artificial Sequence
  neuraminidase__InfluenzaA__AEK29061
augaacccaaaucaaaagauaauaacaauuggcucuguuucucucaccauuuccacaauaugcuucuucauacaaauugccaucuugauaacuacuguaacauugcauuucaagcaauaugaauucaacucccccccaaacaaccaagugaugcugugugaaccaacaauaauagaaaaaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacauaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguggauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauaucccggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcagcagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51390 - RNA, 1410 nt, Artificial Sequence
  neuraminidase__InfluenzaA__AEK29083
augaacccaaaucaaaagauaauaacaauuggcucuguuucucucaccauuuccacaauaugcuucuucauacaaauugccaucuugauaacuacuguaacauugcauuucaagcaauaugaauucaacucccccccaaacaaccaagugaugcugugugaaccaacaauaauagaaaaaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguggauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauaucccggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcagcagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51391 - RNA, 1410 nt, Artificial Sequence
  neuraminidase__InfluenzaA__AEK29094
augaauccaaaucaaaagauaauaacgauuggcucuguuucucucaccauuuccacaauaugcuucuucaugcaaauugccaucuugauaacuacuguaacauugcauuucaagcaauauaaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaaugugacauuacgggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugagcuagguguuccuuuucaucuggggaccaagcaagugugcauagcaugguccagcucgaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaauuguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51392 - RNA, 1410 nt, Artificial Sequence
  neuraminidase__InfluenzaA__AEK29127
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaacagguccgguuauucugguauuuucucuguugaaggcaaaagcugcaucaaucggugcuuuuauguggaguugauuaggggaagaaaagaggaaacugaagucuuguggaccucaaacaguauugugguguuuuguggcaccucagguacauauggaacaggcucauggccugauggggcggaccucaaucucaugccuauauaa

SEQ ID NO: 51393 - RNA, 1410 nt, Artificial Sequence
  neuraminidase__InfluenzaA__AEK29138
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaacagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51394 - RNA, 1410 nt, Artificial Sequence
  neuraminidase__InfluenzaA__AEK29182
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacacaaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuacccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagguaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51395 - RNA, 1410 nt, Artificial Sequence
  neuraminidase__InfluenzaA__AEK29204
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacgagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcuaauacuaaaguacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51396 - RNA, 1410 nt, Artificial Sequence
  neuraminidase__InfluenzaA__AEK29215
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacguaauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51397 - RNA, 1410 nt, Artificial Sequence; identical to SEQ ID NO: 51395
  neuraminidase__InfluenzaA__AEK29237

SEQ ID NO: 51398 - RNA, 1410 nt, Artificial Sequence; identical to SEQ ID NO: 51209
  neuraminidase__InfluenzaA__AEK29248

SEQ ID NO: 51399 - RNA, 1410 nt, Artificial Sequence
  neuraminidase__InfluenzaA__AEK29259
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucaucgaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51400 - RNA, 1410 nt, Artificial Sequence; identical to SEQ ID NO: 51399
  neuraminidase__InfluenzaA__AEK29270

SEQ ID NO: 51401 - RNA, 1413 nt, Artificial Sequence
  neuraminidase__InfluenzaA__AEK59839
augaauccaaaucaaaagauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggccugggcugguuaacaaucggaauuucugguccagacaauggagcuguggcuguacuaaaauacaauggaauaauaacuggaaccauaaaaaguuggaaaaagcaaauauuaagaacacaagagucugaaugugucuguaugaacgggucauguuucaccauaaugaccgauggcccgaguaauggggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuuggguaucuuuuaaucaaaacuuggauuaucaaauaggauacaucugcaguggaguguucggugacaauccgcgucccaaagauggagagggcagcugcaauccagugacuguugauggagcagacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggauuguauaagaccuugcuucuggguugaguuggucagagggcugccuagagaaaauacaacaaucuggacuagugggagcagcauuucuuucuguggcguuaauagugauacugcaaacuggucuuggccagacggugcugaguugccauucaccauugacaaguag

SEQ ID NO: 51402 - RNA, 1410 nt, Artificial Sequence
  neuraminidase__InfluenzaA__AEK98375
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggagaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51403 - RNA, 1410 nt, Artificial Sequence
  neuraminidase__InfluenzaA__AEK98377
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaauauaacagagauaguguaucugaccaacaccaccauagagaaggaaauaugucccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggacuccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggauaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51404 - RNA, 1410 nt, Artificial Sequence
  neuraminidase__InfluenzaA__AEK98379
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggagaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggagcggacaucaaucucaugccuauauaa

SEQ ID NO: 51405 - RNA, 1410 nt, Artificial Sequence
  neuraminidase__InfluenzaA__AEK98381
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggagaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggagaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggagcggacaucaaucucaugccuauauaa

SEQ ID NO: 51406 - RNA, 1410 nt, Artificial Sequence
  neuraminidase__InfluenzaA__AEK98383
augaauccaaaucaaaagauaauaacgauuggcucuguuucucuaaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugccagcuucauuuacaaugggagacuuguagauaguauuguuucaugguccaaagaaauccucaggacccaggagucagaaugcguuuguaucaauggaacuuguacaguaguaaugacugaugggagugcuucaggagaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51407 - RNA, 1410 nt, Artificial Sequence
  neuraminidase__InfluenzaA__AEK98385
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaauauaacagagauaguguaucugaccaacaccaccauagagaaggaaauaugccccaaauuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggagacuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51408 - RNA, 1410 nt, Artificial Sequence
  neuraminidase__InfluenzaA__AEK98387
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacacaaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuauagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuacguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51409 - RNA, 1410 nt, Artificial Sequence
  neuraminidase__InfluenzaA__AEK98389
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaauauaacagagauaguguaucugaccaacaccaccauagagaaggaaauaugucccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggauaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51410 - RNA, 1410 nt, Artificial Sequence
  neuraminidase__InfluenzaA__AEK98393
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcuaugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaauuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugcuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51411 - RNA, 1410 nt, Artificial Sequence
  neuraminidase__InfluenzaA__AEK98395
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaccucaugccuauauaa

SEQ ID NO: 51412 - RNA, 1410 nt, Artificial Sequence
  neuraminidase__InfluenzaA__AEK98397
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggagacaucugggugacaagagaaccuuaugugucaugcgauccuaacaaguguuaucaauuugcccuuggacaaggaacaacacuaaacaacgugcauucaaauaacacaguacgugauaggaccccuuaucggacccucuugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaagagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacaugaaggaucauagcauuguuuccaguuauguguguucaggacuuguuggagacacacccagaaaaaacgacagcuccagcaguagucauuguuuggauccuaacaaugaagaagguggucauggagugaaaggcugggccuuugaugauggaaaugacguguggaugggaagaacgaucagugagaagucacgcuuaggguaugaaaccuucaaagucauugaaggcugguccaacccuaaguccaaauugcagauaaauaggcaaguaauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaauuucaugccuauauaa

SEQ ID NO: 51413 - RNA, 1410 nt, Artificial Sequence
  neuraminidase__InfluenzaA__AEK98399
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaauauaacagagauaguguaucugaccaacaccaccauagagaaggaaauaugucccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggacuccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggauaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51414 - RNA, 1410 nt, Artificial Sequence
  neuraminidase__InfluenzaA__AEK98403
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccacuauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuacccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51415 - RNA, 1410 nt, Artificial Sequence
  neuraminidase__InfluenzaA__AEK98405
augaauccaaaucaaaagauaauaacgauuggcucuguuucucucaccauuuccacaauaugcuucuucaugcaaauugccaucuugauaacuacaguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccacaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccaguucaaguugucacgauggaaaagcauggcugcauguuuguauaacgggggaugauaaaaaugcaacugcuagcuuuauuuacaaugggaggcuuguagauaguauuguuucaugguccaaagaaauccucaggacucaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagauaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51416 - RNA, 1410 nt, Artificial Sequence
  neuraminidase__InfluenzaA__AEK98407
augaauccaaaucaaaagauaauaacgauuggcucuguuucucucaccauuuccacaauaugcuucuucaugcaaauugccaucuugauaacuacaguaacauugcauuucaagcaauaugaauucaacucccccccaaacaaccaagugauguugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacguguuaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagauaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51417 - RNA, 1410 nt, Artificial Sequence; identical to SEQ ID NO: 46959
  neuraminidase__InfluenzaA__AEL11690

SEQ ID NO: 51418 - RNA, 1410 nt, Artificial Sequence; identical to SEQ ID NO: 51336
  neuraminidase__InfluenzaA__AEL89300

SEQ ID NO: 51419 - RNA, 1410 nt, Artificial Sequence
  neuraminidase__InfluenzaA__AEL89310
augaauccaaaccaaaagauaauaaccauugguucggucuguaugacaauuggaauggcuaacuuaauauuacaaauugggaacauaaucucaauauggauuagccacucaauucaacuugggaauaaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcuccccccuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcgguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaggauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaacggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51420 - RNA, 1410 nt, Artificial Sequence; identical to SEQ ID NO: 51336
  neuraminidase__InfluenzaA__AEL89320

SEQ ID NO: 51421 - RNA, 1410 nt, Artificial Sequence; identical to SEQ ID NO: 51336
  neuraminidase__InfluenzaA__AEL89330

SEQ ID NO: 51422 - RNA, 1410 nt, Artificial Sequence; identical to SEQ ID NO: 51336
  neuraminidase__InfluenzaA__AEL89340

SEQ ID NO: 51423 - RNA, 1410 nt, Artificial Sequence; identical to SEQ ID NO: 51336
  neuraminidase__InfluenzaA__AEL89350

SEQ ID NO: 51424 - RNA, 1410 nt, Artificial Sequence; identical to SEQ ID NO: 51336
  neuraminidase__InfluenzaA__AEL89360

SEQ ID NO: 51425 - RNA, 1410 nt, Artificial Sequence; identical to SEQ ID NO: 51336
  neuraminidase__InfluenzaA__AEL89370

SEQ ID NO: 51426 - RNA, 1410 nt, Artificial Sequence; identical to SEQ ID NO: 51336
  neuraminidase__InfluenzaA__AEL89394

SEQ ID NO: 51427 - RNA, 1410 nt, Artificial Sequence; identical to SEQ ID NO: 51336
  neuraminidase__InfluenzaA__AEL89404

SEQ ID NO: 51428 - RNA, 1410 nt, Artificial Sequence; identical to SEQ ID NO: 51336
  neuraminidase__InfluenzaA__AEL89414

SEQ ID NO: 51429 - RNA, 1410 nt, Artificial Sequence; identical to SEQ ID NO: 51336
  neuraminidase__InfluenzaA__AEL89424

SEQ ID NO: 51430 - RNA, 1410 nt, Artificial Sequence; identical to SEQ ID NO: 51336
  neuraminidase__InfluenzaA__AEL89434

SEQ ID NO: 51431 - RNA, 1410 nt, Artificial Sequence; identical to SEQ ID NO: 51336
  neuraminidase__InfluenzaA__AEL89444

SEQ ID NO: 51432 - RNA, 1410 nt, Artificial Sequence; identical to SEQ ID NO: 51336
  neuraminidase__InfluenzaA__AEL89454

SEQ ID NO: 51433 - RNA, 1410 nt, Artificial Sequence
  neuraminidase__InfluenzaA__AEL89464
augaauccaaaccaaaagauaauaaccauugguucggucuguaugacaauuggaauggcuaacuuaauauuacaaauugggaacauaaucucaauauggauuagccacucaauucaacuugggaauaaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcuccccccuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaauggcauaauaacagacacuaucaagaguuggagaaacaauauauugagaacacaagagucugaaugugcauguguaaaugguucuugcuuuacuguaaugaccgauggaccaagugauggacaggccucauacaagaucuucaggauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaacggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagugggagcagcauauccuuuugugguguaaacagugacacuguggguuggucuuggccagacggugcugaguugccauuuaccauugacaaguaa

SEQ ID NO: 51434 - RNA, 1410 nt, Artificial Sequence; identical to SEQ ID NO: 51336
  neuraminidase__InfluenzaA__AEL89474

SEQ ID NO: 51435 - RNA, 1410 nt, Artificial Sequence
  neuraminidase__InfluenzaA__AEL89484
augaauccaaaccagaagauaauaaccauugguucggucuguaugacaauuggaauggcuaacuuaauguuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaauaaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagggggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51436 - RNA, 1410 nt, Artificial Sequence; identical to SEQ ID NO: 51306
  neuraminidase__InfluenzaA__AEL89494

SEQ ID NO: 51437 - RNA, 1410 nt, Artificial Sequence
  neuraminidase__InfluenzaA__AEL89514
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaagaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51438 - RNA, 1410 nt, Artificial Sequence; identical to SEQ ID NO: 51311
  neuraminidase__InfluenzaA__AEL89524

SEQ ID NO: 51439 - RNA, 1410 nt, Artificial Sequence
  neuraminidase__InfluenzaA__AEL89534
augaauccaaaccaaaagauaauaaccauugguucggucuguaugacaauuggaauggcuaacuuaauauuacaaauuggaaacauuaucucaauauggauuagccacucaauucaacuugggaaucaaaaucagauuggaacaugcaaucaaagcgucauuacuuaugaaaacaacacuuggguaaaucagacauauguuaacaucagcaacaccaacuuugcugcuggacagucagugguuuccgugaaauuagcgggcaauuccucccucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaauaaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaaaaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51440 - RNA, 1410 nt, Artificial Sequence
  neuraminidase__InfluenzaA__AEL89544
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuuuucaauaaagcaagauaucguaggaauaaaagaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51441 - RNA, 1410 nt, Artificial Sequence
  neuraminidase__InfluenzaA__AEL89554
augaauccaaaucaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuuuuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaagaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51442 - RNA, 1410 nt, Artificial Sequence
  neuraminidase__InfluenzaA__AEL89564
augaauccaaaccaaaagauaauaaccauugguucggucuguauaacaauuggaauggcuaacuuaauauuacaaauuggaaacauaaucucaauauggauuagccacucaauucaacuugggaaucaaaaucagauugaaacaugcaaucaaagcgucguuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaguuggcugacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51443 - RNA, 1410 nt, Artificial Sequence; identical to SEQ ID NO: 51312
  neuraminidase__InfluenzaA__AEL89574

SEQ ID NO: 51444 - RNA, 1410 nt, Artificial Sequence; identical to SEQ ID NO: 51312
  neuraminidase__InfluenzaA__AEL89584

SEQ ID NO: 51445 - RNA, 1410 nt, Artificial Sequence
  neuraminidase__InfluenzaA__AEL89604
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaccacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucauaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51446 - RNA, 1410 nt, Artificial Sequence; identical to SEQ ID NO: 51094
  neuraminidase__InfluenzaA__AEL89624

SEQ ID NO: 51447 - RNA, 1410 nt, Artificial Sequence
  neuraminidase__InfluenzaA__AEL89634
augaauccaaaccaaaagauaauaaccauugguucggucuguauaacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagagaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaguuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauacaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51448 - RNA, 1410 nt, Artificial Sequence
  neuraminidase__InfluenzaA__AEL89644
augaauccaaaccaaaagauaauaaccauugguucggucuguaugacaauuggaauggcuaacuuaauauuacaaauugggaacauaaucucaauauggauuagccacucaauucaacuugggaauaaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcuccccccuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaggauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51449 - RNA, 1410 nt, Artificial Sequence
  neuraminidase__InfluenzaA__AEL89654
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagacaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51450 - RNA, 1410 nt, Artificial Sequence
  neuraminidase__InfluenzaA__AEL89664
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuuuuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51451 - RNA, 1410 nt, Artificial Sequence; identical to SEQ ID NO: 51094
  neuraminidase__InfluenzaA__AEL89674

SEQ ID NO: 51452 - RNA, 1410 nt, Artificial Sequence; identical to SEQ ID NO: 51094
  neuraminidase__InfluenzaA__AEL89694

SEQ ID NO: 51453 - RNA, 1410 nt, Artificial Sequence
  neuraminidase__InfluenzaA__AEL89704
augaauccaaaccaaaagauaauaaccauugguucggucuguaugacaauuggaauggccaacuuaauauuacaaauuggaaacauaaucuuaauauggauuagccacucaauucaacuugggaaucaaaaucagauugaaacaugcaaucaaagcgucauuacuuaugaaaacaacacuuggguaaaucagacauacguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucauguucccccuuggaaugcaggaccuucuucuugacucaaggggccuugcuaaaugacaaacauuccaauggaaccauuaaagacaggagcccauaucgaacucuaaugagcuguccuauuggugaaguucccucuccauacaacucaagauuugaaucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaaugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacuggaacagacaauaacuucucaguaaagcaagauaucauaggaauaaaugaguggucaggauauagcgggaguuuuguucagcauccagaacuaacagggcuggauuguauaagaccuugcuucuggguugagcuaaucagagggcggcccaaagagaacacaaucuggacuagcgggagcagcauauccuuuugugguguaaacagugacacuguggguuggucuuggccagacggugcugaguugccauuuaccauugacaaguaa

SEQ ID NO: 51454 - RNA, 1410 nt, Artificial Sequence; identical to SEQ ID NO: 51453
  neuraminidase__InfluenzaA__AEL89714

SEQ ID NO: 51455 - RNA, 1410 nt, Artificial Sequence; identical to SEQ ID NO: 51094
  neuraminidase__InfluenzaA__AEL89744

SEQ ID NO: 51456 - RNA, 1410 nt, Artificial Sequence
  neuraminidase__InfluenzaA__AEL89754
augaauccaaaccaaaagauaauaaccauugguucggucuguauaacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaguuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagagcuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaucauugacaaguaa

SEQ ID NO: 51457 - RNA, 1410 nt, Artificial Sequence; identical to SEQ ID NO: 51419
  neuraminidase__InfluenzaA__AEL89774

SEQ ID NO: 51458 - RNA, 1410 nt, Artificial Sequence
  neuraminidase__InfluenzaA__AEL89784
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauacguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucauguucccccuuggaaugcaggaccuucuucuugacucaaggggccuugcuaaaugacaaacauuccaauggaaccauuaaagacaggagcccauaucgaacucuaaugagcuguccuauuggugaaguucccucuccauacaacucaagauuugaaucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguuuaagaaacgguuuugagaugauuugggauccgaacggauggacuggaacagacaauaacuucucaguaaagcaagauaucauaggaauaaaugaguggucaggauauagcgggaguuuuguucagcauccagaacuaacagggcuggauuguauaagaccuugcuucuggguugagcuaaucagagggcggcccaaagagaacacaaucuggacuagcgggagcagcauauccuuuugugguguaaacagugacacuguggguuggucuuggccagacggugcugaguugccauuuaccauugacaaguaa

SEQ ID NO: 51459 - RNA, 1410 nt, Artificial Sequence
  neuraminidase__InfluenzaA__AEL89794
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucauuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacgcuguggguuggucuuggccagacggugcugaguugccauuuaccauugacaaguaa

SEQ ID NO: 51460 - RNA, 1410 nt, Artificial Sequence
  neuraminidase__InfluenzaA__AEL89804
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacaaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagauaauaacuucucaauaaagcaagauaucguaggaauaaaugaguggucaggauauagcgggaguuuuguucagcauccagaacuaacagggcuggauuguauaagaccuugcuucuggguugaacuaaucagagggcggcccaaagagaacacaaucuggacuagcgggagcagcauauccuuuugugguguaaacagugacacuguggguuggucuuggccagacggugcugaguugccauuuaccauugacaaguaa

SEQ ID NO: 51461 - RNA, 1410 nt, Artificial Sequence
  neuraminidase__InfluenzaA__AEL89815
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauacguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucauguucccccuuggaaugcaggaccuucuucuugacucaaggggccuugcuaaaugacaaacauuccaauggaaccauuaaagacaggagcccauaucgaacucuaaugagcuguccuauuggugaaguucccucuccauacaacucaagauuugaaucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacuggaacagacaauaacuucucaguaaagcaagauaucauaggaauaaaugaguggucaggauauagcgggaguuuuguucagcauccagaacuaacagggcuggauuguauaagaccuugcuucuggguugagcuaaucagagggcggcccaaagagaacacaaucuggacuagcgggagcagcauauccuuuugugguguaaacagugacacuguggguuggucuuggccagacggugcugaguugccauuuaccauugacaaguaa

SEQ ID NO: 51462 - RNA, 1410 nt, Artificial Sequence
  neuraminidase__InfluenzaA__AEL89825
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcuccccuuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacugugaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcgcgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51463 - RNA, 1410 nt, Artificial Sequence
  neuraminidase__InfluenzaA__AEL89835
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaauguguauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51464 - RNA, 1410 nt, Artificial Sequence
  neuraminidase__InfluenzaA__AEL89845
augaauccaaaccaaaagauaauaaccauugguucggucuguaugacaauuggaauggcuaacuuaauauuacaaauugggaacauaaucucaauauggauuagccacucaauucaacuugggaauaaaaaucagauugaaacaugcaaucaaagcgucauuacuuaugaaaacaacacuuggguaaaucagacauauguuaacaucagcaacaccaacuuugcuacuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcuccccccuggaaugcagaaccuucuucuugacucaaggggccuugcuaaaugacaaacauuccaauggaaccauuaaagacaggagcccauaucgaacccuaaugagcuguccuauuggugaagcucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaggauagagaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaacggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagugggagcagcauauccuuuugugguguaaacagugacacuguggguuggucuuggccagacggugcugaguugccauuuaccauugacaaguaa

SEQ ID NO: 51465 - RNA, 1410 nt, Artificial Sequence; identical to SEQ ID NO: 51462
  neuraminidase__InfluenzaA__AEL89855

SEQ ID NO: 51466 - RNA, 1410 nt, Artificial Sequence; identical to SEQ ID NO: 51094
  neuraminidase__InfluenzaA__AEL93581

SEQ ID NO: 51467 - RNA, 1410 nt, Artificial Sequence
  neuraminidase__InfluenzaA__AEL93591
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaacuuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51468 - RNA, 1410 nt, Artificial Sequence; identical to SEQ ID NO: 51309
  neuraminidase__InfluenzaA__AEL93601

SEQ ID NO: 51469 - RNA, 1410 nt, Artificial Sequence; identical to SEQ ID NO: 51094
  neuraminidase__InfluenzaA__AEL93611

SEQ ID NO: 51470 - RNA, 1410 nt, Artificial Sequence; identical to SEQ ID NO: 51094
  neuraminidase__InfluenzaA__AEL93621

SEQ ID NO: 51471 - RNA, 1410 nt, Artificial Sequence; identical to SEQ ID NO: 51094
  neuraminidase__InfluenzaA__AEL93631

SEQ ID NO: 51472 - RNA, 1410 nt, Artificial Sequence
  neuraminidase__InfluenzaA__AEL93641
augaauccaaaccaaaagauaauaaccauugguucggucuguauaacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaguuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccauaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcaacccaaagagaacacaaucuggacuagcgggagcagcauauccuuuugugguguaaacagugacacuguggguuggucuuggccagacggugcugaguugccauuuaccauugacaaguaa

SEQ ID NO: 51473 - RNA, 1410 nt, Artificial Sequence; identical to SEQ ID NO: 51312
  neuraminidase__InfluenzaA__AEL94890

SEQ ID NO: 51474 - RNA, 1410 nt, Artificial Sequence
  neuraminidase__InfluenzaA__AEL95429
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccacaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51475 - RNA, 1410 nt, Artificial Sequence
  neuraminidase__InfluenzaA__AEL97634
augaauccaaaccaaaagauaauaaccauugguucggucuguaugacaauuggaauggccaacuuaauauuacaaauuggaaacauaaucucaauauggguuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaguaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51476 - RNA, 1410 nt, Artificial Sequence
  neuraminidase__InfluenzaA__AEL99667
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacagaagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggacaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51477 - RNA, 1410 nt, Artificial Sequence
  neuraminidase__InfluenzaA__AEL99677
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucaaacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51478 - RNA, 1410 nt, Artificial Sequence; identical to SEQ ID NO: 46280
  neuraminidase__InfluenzaA__AEM53471

SEQ ID NO: 51479 - RNA, 1413 nt, Artificial Sequence; identical to SEQ ID NO: 46957
  neuraminidase__InfluenzaA__AEM60040

SEQ ID NO: 51480 - RNA, 1413 nt, Artificial Sequence; identical to SEQ ID NO: 46547
  neuraminidase__InfluenzaA__AEM60061

SEQ ID NO: 51481 - RNA, 1410 nt, Artificial Sequence
  neuraminidase__InfluenzaA__AEM60072
augaauccaaaucaaaagauaauaacaauuggcucuguuucucucaccauugccacaauaugcuuccuuaugcaaauugccauucugguaacuacuguaacauugcauuucaagcaauaugagugcagcucccccccaaacaaccaaguaaugccgugugaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucgacuuuccgcugguggagacauuugggugacaagagaaccuuaugugucaugcgauccuggcaaguguuaucaauuugcacuugggcagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcaugguugcauguuugugucacugggcaugaugaaaaugcaacugcuagcuucauuuacgaugggaggcuuguagacaguauugguucaugguccaaaaauauccucaggacacaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagauccagcaguagcuauugccggaauccuaacaaugagaaagggagucauggagugaaaggcugggccuuugacgauggaaaugacguguggaugggaagaacgaucggagaggaguuacgcucagguuaugaaaccuucaaagucauuggagguugguccacaccuaacuccaaauugcagauaaauaggcaagucauaguugacagcgguaauagguccgguuauucugguauuuucucuguugagggcaaaagcugcaucaaucggugcuuuuauguggaguugauaaggggaagggaacaggaaacuagagucugguggacuucaaacaguauuguuguguuuuguggcaccucagguacauauggaacaggcucauggccugauggggcggacaucaaucucaugccuauauaa

SEQ ID NO: 51482 - RNA, 1410 nt, Artificial Sequence; identical to SEQ ID NO: 47242
  neuraminidase__InfluenzaA__AEM62774

SEQ ID NO: 51483 - RNA, 1410 nt, Artificial Sequence; identical to SEQ ID NO: 47242
  neuraminidase__InfluenzaA__AEM62783

SEQ ID NO: 51484 - RNA, 1410 nt, Artificial Sequence
  neuraminidase__InfluenzaA__AEM62792
augaauccaaaccaaaagauaauaaccauugguucggucuguaugacaauuggaauggcuaacuuaauauuacaaauuggaaacauaaucucaauauggauuagccacucaauucaacuugggagucaaaaucagauugaaacaugcaaucaaagcgucauuacuuaugaaaacaacacuuggguaaaucagacauauguuaacaucagcaacaccaacuuugcugcuggacagucagugauuuccgugagauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuagaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucauaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51485 - RNA, 1410 nt, Artificial Sequence; identical to SEQ ID NO: 47439
  neuraminidase__InfluenzaA__AEM62801

SEQ ID NO: 51486 - RNA, 1410 nt, Artificial Sequence
  neuraminidase__InfluenzaA__AEM62810
augaauccaaaccaaaagauaauaaccauugguucggucuguaugacaauuggaauggguaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51487 - RNA, 1410 nt, Artificial Sequence
  neuraminidase__InfluenzaA__AEM62819
augaauccaaaccaaaagauaauaaccauugguucggucuguaugacaauuggaauggcuaauuuaauauuacaaauuggaaacauaaucucaauauggauuagccacucaauucaacuugggaaucaaaaucagauugaaacaugcaaucaaagcgucauuacuuaugaaaacgacacuuggguaaaucagacauauguuaacaucagcaacaccaacuuugcugcuggacagucagugguuuccgugaaauuagcgggcaauuccucucucugcccuguuaguggaugggcuauauacaguaaagacaauaguauaagaaucgguuccaagggggauguguuugucauaagggaaccauucauaucaugcucccccuuggaaugcagaaccuucuucuugacucaaggggccuugcuaaaugacaaacacuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaacaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51488 - RNA, 1410 nt, Artificial Sequence
  neuraminidase__InfluenzaA__AEM62828
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggccauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauauuguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51489 - RNA, 1410 nt, Artificial Sequence
  neuraminidase__InfluenzaA__AEM62837
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgccccaaugauaagacaggcaguugugguccaguaucgucuaauggagcaaauggaguaaaaggauuuucauucaaauacggcaaugguguuuggauagggagaacuaaaagcauuaguucaagaaacgguuucgagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51490 - RNA, 1410 nt, Artificial Sequence
  neuraminidase__InfluenzaA__AEM62846
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugaggacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51491 - RNA, 1410 nt, Artificial Sequence
  neuraminidase__InfluenzaA__AEM62855
augaauccaaaccaaaagauaauaaccauugguucggucuguauaacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaauggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuggugaaaucacaugugugugcagggauaacuggcauggcucgaaucgaccgugggugucuuucaaccagaaucuggaauaucagauaggauacauaugcagugggauuuucggagacaauccacgcccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51492 - RNA, 1410 nt, Artificial Sequence
  neuraminidase__InfluenzaA__AEM62864
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuuucggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagauuuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51493 - RNA, 1410 nt, Artificial Sequence
  neuraminidase__InfluenzaA__AEM62872
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccaucaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucguuuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51494 - RNA, 1410 nt, Artificial Sequence
  neuraminidase__InfluenzaA__AEM92310
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguuucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51495 - RNA, 1410 nt, Artificial Sequence
  neuraminidase__InfluenzaA__AEM92320
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuuacuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaccgaccgugggugucuuucaaccagaaucuggaauaucagauaggauacauaugcagugggauuuucggagacaauccacgcccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51496 - RNA, 1410 nt, Artificial Sequence
  neuraminidase__InfluenzaA__AEM92340
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgccccaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacuaggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51497 - RNA, 1410 nt, Artificial Sequence
  neuraminidase__InfluenzaA__AEM92350
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuuacuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaccgaccgugggugucuuucaaccagaaucuggaauaucagauaggauacauaugcagugggauuuucggagacaauccacguccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51498 - RNA, 1410 nt, Artificial Sequence
  neuraminidase__InfluenzaA__AEM92360
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcugaacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51499 - RNA, 1410 nt, Artificial Sequence; identical to SEQ ID NO: 51496
  neuraminidase__InfluenzaA__AEM92370

SEQ ID NO: 51500 - RNA, 1410 nt, Artificial Sequence
  neuraminidase__InfluenzaA__AEM92380
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccguaaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgccccaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacuaggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51501 - RNA, 1410 nt, Artificial Sequence
  neuraminidase__InfluenzaA__AEM92399
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguguccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaccaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugacaagacaggcaguugugguccaguauugucuaauggagcaaauggaguaaaaggauuuucauucaaauacggcaaugguguuuggauagggagaacuaaaagcauuaguucaagaaacggguuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51502 - RNA, 1410 nt, Artificial Sequence
  neuraminidase__InfluenzaA__AEM92409
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguguccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaccaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugacaagacaggcaguugugguccaguauugucuaauggagcaaauggaguaaaaggauuuucauucaaauacggcaaugguguuuggauagggagaacuaaaagcauuaguucaagaaacggguuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51503 - RNA, 1410 nt, Artificial Sequence; identical to SEQ ID NO: 47688
  neuraminidase__InfluenzaA__AEM92419

SEQ ID NO: 51504 - RNA, 1410 nt, Artificial Sequence
  neuraminidase__InfluenzaA__AEM92430
augaauccaaaccaaaagauaaugaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51505 - RNA, 1410 nt, Artificial Sequence
  neuraminidase__InfluenzaA__AEM92440
augaauccaaaccaaaagauaauaaccauugguucggucuguauaacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucggacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugauugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaguacggcaaugguguuuggauagggagaacuaaaagcauuaguucaagaaaagguuuugagaugauuugggauccaaacggauggacugggacagacaauaacuucucaauaaagcaagauauuguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51506 - RNA, 1410 nt, Artificial Sequence
  neuraminidase__InfluenzaA__AEM92450
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauucuucucucugcccuguuaguggaugggcuauauacaguaaagacaacaguauaagaaucgguuccaagggggauguguuugucauaagggaaccauucauaucaugcuccccuuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagaguccgaaugugcauguguaaauggcucuugcuuuacugugaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcgcgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccuaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51507 - RNA, 1410 nt, Artificial Sequence; identical to SEQ ID NO: 51506
  neuraminidase__InfluenzaA__AEM92460

SEQ ID NO: 51508 - RNA, 1410 nt, Artificial Sequence
  neuraminidase__InfluenzaA__AEM92470
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaauuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51509 - RNA, 1410 nt, Artificial Sequence; identical to SEQ ID NO: 51508
  neuraminidase__InfluenzaA__AEM92480

SEQ ID NO: 51510 - RNA, 1410 nt, Artificial Sequence
  neuraminidase__InfluenzaA__AEM92490
augaauccaaaccaaaagauaauaaccauugguucggucuguaugauaauuggaauggcuaacuuaauguuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51511 - RNA, 1410 nt, Artificial Sequence
  neuraminidase__InfluenzaA__AEM92500
augaauccaaaccaaaagauaauaaccauugguucggucuguaugauaauuggaauggcuaacuuaauguuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaaaggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagaugggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaaauucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51512 - RNA, 1410 nt, Artificial Sequence
  neuraminidase__InfluenzaA__AEM92520
augaauccaaaccaaaagauaauaaccauugguucggucuguaugacaauuggaauggcuaacuuaauguuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggcccugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugggucuugcuuuacuguaaugaccgauggaccaagugauggacaggccucauacaagaucuucagaauagaaaagggaaagauagucaaaucagucgaaaugaaugccccuaauuaccacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugaaaugauuugggauccgaacggauggacugggacagacaauaacuucucaauaaagcaagauaucauaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51513 - RNA, 1410 nt, Artificial Sequence
  neuraminidase__InfluenzaA__AEM92550
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcugucccauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51514 - RNA, 1410 nt, Artificial Sequence
  neuraminidase__InfluenzaA__AEM92570
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaaggggaauguguuugucauaagggaaccauucauaucaugcucccccuuggaaugcagaaccuucuucuugacucaaggggccuugcuaaaugauaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51515 - RNA, 1410 nt, Artificial Sequence
  neuraminidase__InfluenzaA__AEM92580
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51516 - RNA, 1410 nt, Artificial Sequence
  neuraminidase__InfluenzaA__AEM92590
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugauaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcugugcuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51517 - RNA, 1410 nt, Artificial Sequence
  neuraminidase__InfluenzaA__AEM92600
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51518 - RNA, 1410 nt, Artificial Sequence
  neuraminidase__InfluenzaA__AEM92610
augaauccaaaccaaaagauaauaaccauugguucggucuguaugacaauuggaauggcuaacuuaauguuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacugugaguuggucuuggccagacggugcugaguugccauuuaccauugacaaguaa

SEQ ID NO: 51519 - RNA, 1410 nt, Artificial Sequence
  neuraminidase__InfluenzaA__AEM92620
augaauccaaaccaaaagauaauaaccauugguucggucuguaugauaauuggaauggcuaacuuaauguuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaaaggggauguguuugucauaagggaaccauucauaucaugcucccccuuggaaugcagaaccuucuucuugacucaaggggccuugcuagaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagaugggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaaauucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51520 - RNA, 1410 nt, Artificial Sequence
  neuraminidase__InfluenzaA__AEM92650
augaauccaaaccaaaagauaauaaccauugguucagucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauucuucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguuucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacuggaacagacacuaaauucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51521 - RNA, 1410 nt, Artificial Sequence; identical to SEQ ID NO: 49914
  neuraminidase__InfluenzaA__AEM98410

SEQ ID NO: 51522 - RNA, 1410 nt, Artificial Sequence; identical to SEQ ID NO: 49914
  neuraminidase__InfluenzaA__AEM98421

SEQ ID NO: 51523 - RNA, 1410 nt, Artificial Sequence; identical to SEQ ID NO: 49914
  neuraminidase__InfluenzaA__AEM98432

SEQ ID NO: 51524 - RNA, 1410 nt, Artificial Sequence
  neuraminidase__InfluenzaA__AEN55401
augaauccaaaccaaaagauaauaaccauugguucggucuguauaacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaguuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagaaaacacaaucuggacuagcgggagcagcauauccuuuugugguguaaacagugacacuguggguuggucuuggccagacggugcugaguugccauuuaccauugacaaguaa

SEQ ID NO: 51525 - RNA, 1410 nt, Artificial Sequence; identical to SEQ ID NO: 51336
  neuraminidase__InfluenzaA__AEN55411

SEQ ID NO: 51526 - RNA, 1410 nt, Artificial Sequence
  neuraminidase__InfluenzaA__AEN55421
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuagacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaauguguauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51527 - RNA, 1410 nt, Artificial Sequence
  neuraminidase__InfluenzaA__AEN55466
augaauccaaaccaaaagauaauaaccauugguucggucuguauaacaauuggaauggcuaacuuaauauuacaaauuggaaacacaaucucaauauggauuagccacucaauucaacuugggaaucaaaaucagauugaaacaugcaaucaaagcgucauuacuuaugaaaacaacacuugggugaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaguuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51528 - RNA, 1410 nt, Artificial Sequence
  neuraminidase__InfluenzaA__AEN55476
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacugugaguuggucuuggccagacggugcugaguugccauuuaccauugacaaguaa

SEQ ID NO: 51529 - RNA, 1410 nt, Artificial Sequence; identical to SEQ ID NO: 51094
  neuraminidase__InfluenzaA__AEN55486

SEQ ID NO: 51530 - RNA, 1410 nt, Artificial Sequence; identical to SEQ ID NO: 51094
  neuraminidase__InfluenzaA__AEN55506

SEQ ID NO: 51531 - RNA, 1410 nt, Artificial Sequence
  neuraminidase__InfluenzaA__AEN55516
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuucugugaaauuagcgggcaauuccucucucugcccuguuaguggaugggcuauauacaguaaagacaacaguauaagaaucgguuccaggggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51532 - RNA, 1410 nt, Artificial Sequence; identical to SEQ ID NO: 51094
  neuraminidase__InfluenzaA__AEN55526

SEQ ID NO: 51533 - RNA, 1410 nt, Artificial Sequence; identical to SEQ ID NO: 51361
  neuraminidase__InfluenzaA__AEN69429

SEQ ID NO: 51534 - RNA, 1410 nt, Artificial Sequence; identical to SEQ ID NO: 51287
  neuraminidase__InfluenzaA__AEN69438

SEQ ID NO: 51535 - RNA, 1410 nt, Artificial Sequence; identical to SEQ ID NO: 51336
  neuraminidase__InfluenzaA__AEN69484

SEQ ID NO: 51536 - RNA, 1410 nt, Artificial Sequence
  neuraminidase__InfluenzaA__AEO01627
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuucugcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguggccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggaaaucaaucucaugccuauauag

SEQ ID NO: 51537 - RNA, 1410 nt, Artificial Sequence
  neuraminidase__InfluenzaA__AEO01638
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuucugcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguggccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcugaaaucaaucucaugccuauauag

SEQ ID NO: 51538 - RNA, 1410 nt, Artificial Sequence
  neuraminidase__InfluenzaA__AEO01644
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguucgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaaugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaccgacagcuccagcaguggccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauag

SEQ ID NO: 51539 - RNA, 1410 nt, Artificial Sequence
  neuraminidase__InfluenzaA__AEO01654
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuucugcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguggccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacuaaagucuuguggaccucaaacaguauuguuguguuuuguggcaccucagguacauauggaacaggcucauggccugauggggcugaaaucaaucucaugccuauauag

SEQ ID NO: 51540 - RNA, 1413 nt, Artificial Sequence
  neuraminidase__InfluenzaA__AEO01665
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagauugaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauacugacagugauuucucagugaaacaggauguuguagcaauaacugauuggucaggguacaguggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 51541 - RNA, 1413 nt, Artificial Sequence
  neuraminidase__InfluenzaA__AEO01676
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagauugaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauacugacagugauuucucagugaaacaggauguuguagcaauaacugauuggucaggguacaguggaaguuucguccaacauccugaguuaacaggauuggacuguauaagaccuugcuucuggguugaguuagucagagggcugccuagagaaaauacaacaaucuggacuagugggagcagcauuuuuuuucguggcgauaauagugauacugcaaacuggucuuggccagacggugcugagaugacguucaccauugacaaguag

SEQ ID NO: 51542 - RNA, 1410 nt, Artificial Sequence
  neuraminidase__InfluenzaA__AEO01693
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuucugcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucauuuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguggccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcugaaaucaaucucaugccuauauag

SEQ ID NO: 51543 - RNA, 1413 nt, Artificial Sequence
  neuraminidase__InfluenzaA__AEO01711
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauacugacagugauuucucagugaaacaggauguuguagcaauaacugauuggucaggguacaguggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguaa

SEQ ID NO: 51544 - RNA, 1410 nt, Artificial Sequence; identical to SEQ ID NO: 51312
  neuraminidase__InfluenzaA__AEO37533

SEQ ID NO: 51545 - RNA, 1410 nt, Artificial Sequence
  neuraminidase__InfluenzaA__AEO37543
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaccaugcaaucaaagcgucauuacuuaugaaaacaacacuuggguaaaucagacauacguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucauguucccccuuggaaugcaggaccuucuucuugacucaaggggccuugcuaaaugacaaacauuccaauggaaccauuaaagacaggagcccauaucgaacucuaaugagcuguccuauuggugaaguucccucuccauacaacucaagauuugaaucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacuggaacagacaauaacuucucaguaaagcaagauaucauaggaauaaaugaguggucaggauauagcgggaguuuuguucagcauccagaacuaacagggcuggauuguauaagaccuugcuucuggguugagcuaaucagagggcggcccaaagagaacacaaucuggacuagcgggagcagcauauccuuuugugguguaaacagugacacuguggguuggucuuggccagacggugcugaguugccauuuaccauugacaaguaa

SEQ ID NO: 51546 - RNA, 1410 nt, Artificial Sequence; identical to SEQ ID NO: 51094
  neuraminidase__InfluenzaA__AEO72179

SEQ ID NO: 51547 - RNA, 1350 nt, Artificial Sequence
  neuraminidase__InfluenzaA__AEO88957
augaauccaaaucagaagauaauaaccauuggaucaaucuguaugguaauuggaauaguuagcuuaauguuacagauugggaacaugaucucaauaugggucagucauucaacucaaacagggaaucaacaccaagcugaaccaaucagaaauacuaauuuucuuacugagaacgcuguggcuucaguaacauuagcgggcaauucaucucuuugccccauuagaggaugggcuguacacaguaaagacaacaguauaaggauugguuccaagggggauguguuuguaauuagagagccguucaucucaugcucccauuuggaaugcagaacuuucuuuuugacucagggagccuuacugaaugacaagcacuccaacggaacugucaaagacagaagcccucacagaacacuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacaccaucaagaguuggaggaacaacauauugagaacucaagagucugaaugugcauguguaaauggcucuugcuuuacuguaaugacugauggaccaaguaauggacaggcaucauauaagaucuucaaaauggaaaaagggaaaguaguuaaaucagucgaauugaaugcuccuaauuaucacuaugaggaaugcuccuguuauccugaugcuggcgaaaucauaugugugugcagggauaauuggcauggcucaaauaggccauggguaucuuucaaucagaauuuggaguaucaaauaggauauauaugcaguggaguuuucggagacaauccacgccccaaugauggaacagguaguugugguccaguguccccuaacggggcauaugggauaaaaggguuuucauuuaaauacggcaaugguguuuggaucgggagaaccaaaagcacuaauuccaggagcggcuuugaaaugauuugggauccaaauggguggacuggaacggacaguaacuuuucggugaaacaagauauaguagcaauaacugauuggucaggauauagcgggaguuuuguccagcauccagaacugacaggauuagauugcauaagaccuugcuucuggguugaguuaaucagagggcggcccaaagagaguacaauuuggacuagugggagcagcauaucuuuuugugguguaaauagugacacugugaguuggucuuggccagacggugcugaguugccauucaccauugacaaguag

SEQ ID NO: 51548 - RNA, 1350 nt, Artificial Sequence
  neuraminidase__InfluenzaA__AEO88965
augaauccaaaucagaagauaauaaccaucggaucaaucuguaugguaauugaaauaguuagcuuaauguuacaaauugggaacaugaucucaauaugggucagucauucaauucagacaaagaaucagcgccaagcugaaccgaucagcaauacuaaauuucuuacugagaaagcuguggcuucaguaacauuagcgggcaauucaucucuuugccccauuagcggaugggcuguacacaguaaggacaacagcauaaggaucgguuccaagggggauguguuuguuauaagagagccguucaucucaugcucccacuuggaaugcagaacuuucuuuuugacucagggagccuugcugaaugauaagcacuccaaugggacugucaaagacagaagcccucacagaacauuaaugaguuguccugugggugaggcucccucuccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaacaacauacugagaacucaagagucugaaugugcauguguaaauggcucuugcuuuacuguaaugacugauggaccaaguaaugggcaggcaucauauaagaucuucaaaauggaaaaagggaaagugguuaaaucaguugaauuggaugcuccuaauuaucacuaugaggaaugcuccuguuauccugaugccggagaaaucacaugugugugcagggauaauuggcauggcucaaauaggccauggguaucauucaaucaaaauuuagaguaucaaauaggauauauaugcaguggaguuuucggagacaauccacgccccaaugauggaacagguagcugugguccgguguccccuaauggggcauaugggguaaaaggguuuucauuuaaauacggcaaugguguuuggaucgggagaaccaaaagcacuaauuccaggagcggcuuugaaaugauuugggauccaaauggguggacuggaacggacagcagcuuuucggugaagcaagauaucguagcaauaacugauuggucaggauauagcgggaguuuuguccagcauccagaacugacagguuuaaauugcauaagaccuuguuucuggguugaguuagucagagggcggcccaaagagagcacaaucuggacuagugggagcagcauaucuuuuuguggugugaauagugacacuguggguuggucuuggccagacggugcugaguugccauucaccauugacaaguag

SEQ ID NO: 51549 - RNA, 1350 nt, Artificial Sequence
  neuraminidase__InfluenzaA__AEO88973
augaauccaaaucagaagauaauaaccauugggucaaucuguaugguaauuggaauaguuagcuuaauguuacaaauugggaacaugaucucauuaugggucagucauucaauucagacagggaaucaacaccaaguugaaccaaucagcaauacuaauuuucuuacugagaaagcgguggcuucaguaacauuagcgggcaauucaucucuuugcccaauuagaggaugggcuguacacaguaaggacaacaguauaaggauugguuccaaaggggauguguuuguuauuagagagccauucaucucaugcucccacuuggaaugcagaacuuucuuuuugacucagggagccuugcugaaugacaagcacuccaacgggacugucaaagacagaagcccucacagaacauuaaugaguuguccugugggugaggcucccuccccauauaacucaagguuugaaucuguugcuuggucagcaagugcuugccaugauggcaccaguugguugacaauuggaauuucuggcccagacaauggggcuguggcuguauugaaauacaauggcaugauaacagacaccaucaagaguuggaggaacaacauacugagaacucaagagucugaaugugcauguguaaauggcucuugcuuuacuguaaugacugauggaccaaguaaugggcaggcaucauauaagaucuucaaaauggaaaaaggaagagugguuaaaucagucgaauuggaugcuccuaauuaccacuaugaggaaugcuccuguuauccugaugccggcgaaaucacaugugugugcagggauaauuggcauggcucaaaucggccauggguaucuuucaaucaaaauuuggaguaucaaauaggauauauaugcagcggaguuuucggggacaauccacgccccaaugauggaacagguaguugugguccgguguccccuaauggggcauaugggguaaaaggguuuucauuuaaauacggcaaugguguuuggaucgggagaaccaaaagcccuaauuccaggagcggcuuugaaaugauuugggauccaaauggguggauugaaacggacaguagcuucucggugaaacaagauauaguagcaauaacugauuggucaggauauagcgggaguuuuguccagcauccagaacugacaggauuagauugcauaagaccuuguuucuggguugaguuaaucagagggcggcccaaagagagcacaauuuggacuagugggagcagcauauccuuuugugguguaaauagugacacugugaguuggucuuggccagacggugcugaguugccauucaccauugacaaguaa

SEQ ID NO: 51550 - RNA, 1350 nt, Artificial Sequence
  neuraminidase__InfluenzaA__AEO88982
augaauccaaaucagaagauaauaaccauugggucaaucuguaugguaauuggaauaguuagcuuaauguuacaaauugggaacaugaucucaauaugggucagucauucaauucaaacagggaaucaacaccaagcugaaccaaucagaaacacuaauuuucuuacugagaacgcuguggcuucaguaacauuagcgggcaauucaucucuuugccccguuagaggaugggcuguacacaguaaggacaacaguauaaggauugguuccaagggggauguguuuguuauuagagagccguucaucucaugcucccacuuggaaugcagaacuuucuuuuugacucagggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacaccaucaagaguuggaggaacaacauacugagaacucaagagucugaaugugcauguguaaauggcucuugcuuuacuguaaugacugauggaccaaguaauggccaggcaucauauaagaucuucaaaauggaaaaagggaaagugguuaaaucagucgaauugaaugcuccuaauuaucacuaugaggaaugcuccuguuauccugaugcuggcgaaaucacaugugugugcagggauaauuggcauggcucaaauaggccauggguaucuuucaaucagaauuuggaguaucaaauaggauauauaugcaguggaauuuucggagacaauccacgcccccaugauggaacagguaguugugguccaguguccccuaacggggcauaugggauaaaaggguuuucauuuaaauacggcaaugguguuuggaucgggagaaccaaaagcacuaauuccaggagcggcuuugaaaugauuugggauccaaauggguggacuggaacggacaguaacuuuucggugaaacaagauauaguagcaauaacugauuggucaggauauagcgggaguuuuguccagcauccagaacugacaggauuagauugcauaaggccuugcuucuggguugaguuaaucagagggcggcccaaagagagcacaauuuggacuagugggagcagcauaucuuuuugugguguaaauagugacacugugaguuggucuuggccagacgaugccgaguugccauucaccauugacaaguag

SEQ ID NO: 51551 - RNA, 1350 nt, Artificial Sequence
  neuraminidase__InfluenzaA__AEO88990
augaauccaaaucagaagauaauaaccauugggucaaucuguaugguaauuggaauaguuagcuuaauguuacaaauugggaacaugaucucaauaugggucagucauucaauucaaacagggaaucaacaccaagcugaaccaaucagaaacacuaauuuucuuacugagaacgcuguggcuucaguaacacuagcgggcaauucaucucuuugccccguuagaggaugggcuguacacaguaaggacaacaguauaaggauugguuccaagggggauguguuuguuauuagagagccguucaucucaugcucccacuuggaaugcagaacuuucuuuuugacucagggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacaccaucaagaguuggaggaacaacauacugagaacucaagagucugaaugugcauguguaaauggcucuugcuuuacuguaaugacugauggaccaaguaaugggcaggcaucauauaagaucuucaaaauggaaaaagggaaagugguuaaaucagucgaauugaaugcuccuaauuaucacuaugaggaaugcuccuguuauccugaugcuggcgaaaucacaugugugugcagggauaauuggcauggcucaaauaggccauggguaucuuucaaucagaauuuggaguaucaaauaggauauauaugcaguggaguuuucggagacaauccacgccccaaugauggaacagguaguugugguccaguguccccuaacggggcauaugggauaaaaggguuuucauuuaaauacggcaauggugucuggaucggaagaaccaaaagcacuaauuccaggagcggcuuugaaaugauuugggauccaaauggguggacuggaacggacaguaacuuuucggugaaacaagauauaguagcaauaacugauuggucaggauauagcgggaguuuuguccagcauccagaacugacaggauuagauugcauaaggccuugcuucuggguugaguuaaucagagggcggcccaaagagagcacaauuuggacuagugggagcagcauaucuuuuugugguguaaauagugacacugugaguuggucuuggccagacgaugccgaguugccauucaccauugacaaguag

SEQ ID NO: 51552 - RNA, 1350 nt, Artificial Sequence
  neuraminidase__InfluenzaA__AEO88998
augaauccaaaucagaagauaauaaccauuggaucaaucuguaugguaauuggaauaguuagcuuaauguuacagauugggaacaugaucucaauaugggucagucauucaauucaaacagggaaucaacaccaagcugaaccaaucagaaauacuaauuuucuuacugagaacgcuguggcuucaguaacauuagcgggcaauucaucucuuugccccauuagaggaugggcuguacacaguaaagacaacaguauaaggauugguuccaagggggauguguuuguaauuagagagccguucaucucaugcucccauuuggaaugcagaacuuucuuuuugacucagggagccuuacugaaugacaagcacuccaacgggacugucaaagacagaagcccucacagaacacuaaugaguuguccugugggugaggcucccuccccauauaacucaagguuugagucuguugcuuggucagcaagugcuugccaugauggcaccaguugguugacaauuggaauuucugguccagacaauggggcuguggcuguguugaaauacaauggcauaauaacagacaccaucaagaguuggaggaacaacauacugagaacucaagagucugaaugugcauguguaaauggcucuugcuuuacuguaaugacugauggaccaaguaaugaacaggcaucauauaagaucuucaaaauggaaaaaggaaaaguaguuaaaucagucgaauugaaugcuccuaauuaucacuaugaggaaugcuccuguuauccugaugcuggcgaaaucauaugugugugcagggauaauuggcauggcucaaauaggccauggguaucuuucaaucagaauuuggaguaucaaauaggauauauaugcaguggaguuuucggagacaauccacgccccaaugauggaacagguaguugugguccaguguccccuaacggggcauaugggauaaaaggguuuucauuuaaauacggcaaugguguuuggaucgggagaaccaaaagcacuaauuccaggagcggcuuugaaaugauuugggauccaaauggguggacuggaacggacaguaacuuuucggugaaacaagauauaguagcaauaacugauuggucaggguauagcgggaguuuuguccagcauccagaacugacaggauuagauugcauaagaccuugcuucuggguugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 51553 - RNA, 1350 nt, Artificial Sequence
  neuraminidase__InfluenzaA__AEO89006
augaauccaaaucagaagauaauaaccauugggucaaucuguaugguaauuggaauaguuagcuuaauguuacaaauugggaacaugaucucaauaugggucagucauucaauucaaacagggaaucaacaccaagcugaaccaaucagaaauacuaauuuucuuacugagaacgcuguggcuucaguaacauuagcgggcaauucaucucuuugccccguuagaggaugggcuguacacaguaaagacaacaguauaaggauugguuccaagggggauguguuuguuauuagagagccguucaucucaugcucccacuuggaaugcagaacuuucuuuuugacucagggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacaccaucaagaguuggaggaacaacauacugagaacucaagagucugaaugugcauguguaaauggcucaugcuuuacuguaaugacugauggaccaaguaaugggcaggcaucauauaagaucuucaaaauggaaaaagggaaagugguuaaaucagucgaauugaaugcuccuaauuaucacuaugaggaaugcuccuguuauccugaugcuggcgaaaucacaugugugugcagagauaauuggcauggcucaaauaggccauggguaucuuucaaucagaauuuggaguaucaaauaggauauauaugcaguggaguuuucggagacaauccacgccccaaugauggaacagguaguugugguccaguguccccuaacggggcauaugggauaaaaggguuuucauuuaaauacggcaaugguguuuggaucggaagaaccaaaagcacuaauuccaggagcggcuuugaaaugauuugggauccaaauggguggacuggaacggacagugacuuuucggugaaacaagauauaauagcaauaacugauuggucaggauauagcgggaguuuuguccagcauccagaacugacaggauuagauugcauaagaccuugcuucuggguugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 51554 - RNA, 1350 nt, Artificial Sequence
  neuraminidase__InfluenzaA__AEO89023
augaauccaaaucagaagauaauaaccauugggucaaucuguaugguaauuggaauaguuagcuuaauguuacaaauugggaacauggucucauuaugggucagucauucaauucagacagggaaucaacaccaaguugaaccaaucagcaauacuaauuuucuuacugagaaagcuguggcuucaguaacauuagcgggcaauucaucucuuugccccauuagaggaugggcuguacacaguaaggacaacaguauaaggauugguuccaaaggggauguguuuguuauuagagagccauucaucucaugcucccacuuggaaugcagaacuuucuuuuugacucagggagccuugcugaaugacaagcacuccaacgggacugucaaagacagaagcccucacagaacauuaaugaguuguccugugggugaggcucccuccccauauaacucaagguuugaaucuguugcuuggucagcaagugcuugccaugauggcaccaguugguugacaauuggaauuucuggcccagacaauggggcuguggcuguauugaaauacaauggaaugauaacagacaccaucaagaguuggaggaacaacauacugagaacucaagagucugaaugugcauguguaaauggcucuugcuuuacuguaaugacugauggaccaaguaaugggcaggcaucauauaagaucuucaaaauggaaaaaggaaaagugguuaaaucagucgaauuggaugcuccuaauuaccacuaugaggaaugcuccuguuauccugaugccggcgaaaucacaugugugugcagggauaauuggcauggcucaaaucggccauggguaucuuucaaucaaaauuuggaguaucaaauaggauauauaugcagcggaguuuucggggacaauccacgccccaaugauggaacagguaguugugguccgguguccccuaauggggcauaugggguaaaaggguuuucauuuaaauacggcaaugguguuuggaucgggagaaccaaaagcccuaguuccaggagcggcuuugaaaugauuugggauccaaauggguggacugaaacggacaguagcuucucggugaaacaagauauaguagcaauaacugauuggucaggauauagcgggaguuuuguccagcauccagaacugacaggauuagauugcauaagaccuuguuucuggguugaguuaaucagagggcggcccaaagagagcacaauuuggacuagugggagcagcauauccuuuugugguguaaauagugacacugugaguuggucuuggccagacggugcugaguugccauucaccauugacaaguaa

SEQ ID NO: 51555 - RNA, 1350 nt, Artificial Sequence
  neuraminidase__InfluenzaA__AEO89032
augaauccaaaucagaagauaauaaccauugggucaaucuguaugguaauuggaauaguuagcuuaauguuacaaauugggaacaugaucucaauaugggucagucauucaauucaaacagggaaucaacaccaagcugaaccaaucagaaacacuaauuuucuuacugagaacgcuguggcuucaguaacauuagcgggcaauucaucucuuugccccguuagaggaugggcuguacacaguaaagacaacaguauaaggauugguuccaagggggauguguuuguuauuagagagccguucaucucaugcucccacuuggaaugcagaacuuucuuuuugacucagggagccuuacugaaugacaagcacuccaaugggacugucaaagacagaagcccucacagaacauuaaugaguuguccugugggugaggcucccucccccuauaacucaagguuugagucuguugcuuggucagcaagugcuugccaugauggcaccaguugguugacaauuggaauuucuggcccagacaauggggcuguggcuguauugaaauacaauggcauaauaacagacaccaucaagaguuggaggaacaacauacugagaacucaagagucugaaugugcauguguaaauggcucuugcuuuacuguaaugacugauggaccaaguaaugggcaggcaucauauaagaucuucaaaauggaaaaaggaaaagugguuaaaucagucgaauugaaugcuccuaauuaucacuaugaggaaugcuccuguuauccugaugcgggcgaaaucacaugugugugcagggauaauuggcauggcucaaauaggccauggguaucuuucaaucagaauuuggaguaucaaauaggauauauaugcaguggaguuuucggagacaauccacgccccaaugauggaacagguaguugugguccaguguccccuaacggggcauaugggauaaaaggguuuucauuuaaauacggcaaugguguuuggaucggaagaaccaaaagcacuaauuccaggagcggcuuugaaaugauuugggauccaaauggguggacuggaacggacaguaacuuuucggugaaacaagauauaguagcaauaacugauuggucaggauauagcgggaguuuuguccagcauccagaacugacaggauuagauugcauaaggccuugcuucuggguugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 51556 - RNA, 1350 nt, Artificial Sequence
  neuraminidase__InfluenzaA__AEO89041
augaauccaaaucagaagauaauaaccauugggucaaucuguaugguaauuggauuagucagcuuaauguuacaaauugggaacaugaucucaauaugggucagucauucaauucaaacagggaaucaacaccaagcugaaccaaucagaaauacuaauuuucuuacugagaacgcuguggcuucaguaacauuagcgggcaauucaucucuuugccccguuagaggaugggcuguacacaguaaagacaacaguauaaggauugguuccaagggggauguguuuguuauuagagagccguucaucucaugcucccacuuggaaugcagaacuuucuuuuugacucaaggagccuuacugaaugacaagcacuccaaugggacugucaaagacagaagcccucacagaacauuaaugaguuguccugugggagaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacaccaucaagaguuggaggaacaacauacugagaacucaagagucugaaugugcauguguaaauggcucuugcuuuacuguaaugacugauggaccaaguaaugggcaggcaucauauaagaucuucaaaauggaaaaagggaaagugguuaaaucagucgaauugaaugcuccuaauuaucacuaugaggaaugcuccuguuauccugaugcuggcgaaaucacaugugugugcagggauaauuggcauggcucaaauaggccauggguaucuuucaaucagaauuuggaguaucaaauaggauauauaugcaguggaguuuucggagacaauccacgccccaaugauggaacagguaguugugguccaguguccccuaacggggcauaugggauaaaaggguuuucauuuaaauacggcaaugguguuuggaucggaagaaccaaaagcacuaauuccaggagcggcuuugaaaugauuugggauccaaauggguggacuggaacggacaguaacuuuucggugaaacaagauauaguagcaauaacugauuggucaggauauagcgggaguuuuguccagcauccagaacuaacaggauuagauugcauaagaccuugcuucuggauugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 51557 - RNA, 1350 nt, Artificial Sequence
  neuraminidase__InfluenzaA__AEO89050
augaauccaaaucagaagauaauaaccauuggaucaaucuguaugguaauuggaauaguuagcuuaauguuacagauugggaacaugaucucaauaugggucagucauucaauucaaacagggaaucaacaccaagcugaaccaaucagaaauacuaauuuucuuacugagaacgcuguggcuucaguaacauuagcgggcaauucaucucuuugccccauuagaggaugggcuguacacaguaaagacaacaguauaaggauuggguccaagggggauguguuuguaauuagagagccguucaucucaugcucccaucuggaaugcagaacuuucuuuuugacucagggagccuuacugaaugacaagcacuccaacgggaccgucaaagacagaagcccucacagaacacuaaugaguuguccuaugggugaggcucccuccccauauaacucgagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauacugaggacucaagagucugaaugugcauguguaaauggcucuuguuuuacuguaaugacagauggaccaaguaauggacaggcaucauauaagaucuucaaaauggaaaaagggaaaguaguuaaaucagucgaacugaaugcuccuaauuaucacuaugaagaaugcuccuguuauccugaugcuggcgaaaucauaugugugugcagggauaauuggcauggcucaaauaggccauggguaucuuucaaucagaauuuggaguaucaaauaggauauauuugcaguggaguuuucggagacaauccacggccaaaugaugggacagguaguugugguccaguguccccuaacggggcauaugggauaaaaggguuuucauuuaaauacggcaaugguguuuggaucgggagaaccaaaagcacuaauuccaggagcggcuuugaaaugauuugggauccaaauggguggacuggaacggacagugacuuuucggugaaacaagauauaguagcaauaacugauuggucaggauauagcgggaguuuuguccagcauccagaacugacaggauuagauugcauaagaccuugcuucuggguugaguuaaucagagggcggccaaaagagagcacaauuuggacuagugggagcagcauaucuuuuugugguguaaauagugacacugugaguuggucuuggccagacggugcugaguugccauucaccauugacaaguag

SEQ ID NO: 51558 - RNA, 1350 nt, Artificial Sequence
  neuraminidase__InfluenzaA__AEO89058
augaauccaaaucagaagauaauaaccaucggaucaaucuguaugguaauuggaauaguuagcuuaauguuacaaauugggaacaugaucucaauaugggucagucauucaauucagacagggaaucaacgccaagcugaaccaaucagcaauacuaaauuucuuacugagaaagcuguggcuucaguaacauuagcgggcaauucaucucuuugccccauuagcggaugggcuguauacaguaaggacaacaguauaaggaucgguuccaggggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauacugagaacucaagagucugaaugugcauguguaaauggcucuugcuuuacuguaaugacugauggaccaaguaaugggcaggcaucauauaagaucuucaaaauggaaaaagggaaagugguuaaaucagucgaauuggaugcuccuaauuaucacuaugaggagugcuccuguuauccugaugccggcgaaaucacaugugugugcagggauaauuggcauggcucaaauaggccauggguaucuuucaaucaaaauuuggauuaucaaauaggauauauaugcaguggaguuuucggagacaauccacgccccaaugauggaacagguaguugugguccgguguccccuaacggggcauaugggguaaaaggguuuucauuuaaauacggcaaugguguuuggaucgggagaaccaaaagcacuaauuccaggagcggcuuugaaaugauuugggauccaaauggguggacuggaacggacaguagcuuuucggugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccagugggagcagcauaucuuuuugugguguaaauagugacacuguuaguuggucuuggccagacggugcugaguugccauucaccauugacaaguag

SEQ ID NO: 51559 - RNA, 1350 nt, Artificial Sequence
  neuraminidase__InfluenzaA__AEO89075
augaauccaaaucaaaagauaauaaccauugggucaaucuguaugguaauuggaauaguuagcuuaauguuacaaauugggaacaugaucucaauaugggucagucauucaauucagagagggaaucuaaaccaaguugaaccaaucagcaauacuaauuuucuuacugagaaagcuguggcuucaguaacauuagcgggcaauucaucucuuugcccuauuagagguugggcuauacacaguaaagacaacaguauaaggauugguuccaagggggauguguuuguuauuagagagccauucaucucaugcucccacuuggaaugcagaacuuucuuuuugacucagggagccuugcugaaugacaagcacuccaacgggacugucaaagacagaagcccucacagaacauuaaugaguuguccugugggugagguccccuccccauauaacucaagguuugagucuguugcuuggucagcaagugcuugccaugauggcaccaguugguugacaauuggaauuucuggcccagacaauggggcuguggcuguagugaaauacaauggcauaauaacagacaccaucaagaguuggaggaacaacauacugagaacucaagagucugaaugugcauguguaaauggcucuugcuuuacuguaaugacugacggaccaaguaaugggcaggcaucauauaagaucuucaaaauggaaaaaggaaaaguaauuaaaucagucgaauuggaugcuccuaauuaccacuaugaggaaugcuccuguuauccugaugccggcgaaaucacaugugugugcagggauaauuggcaugguucaaaucggccauggguguccuucaaucaaaaucuggaguaucaaauaggauauauaugcaguggaguuuucggagacaauccacgccccaaugauggaacagguaguugugguccgguguccccuaauggggcauaugggguaaaaggguuuucauuuaaauacggcaaugguguuuggaucgggagaaccaaaagcccuaauuccaggagcggcuuugaaaugauuugggauccaaauggguggagugaaacggacaguagcuucucggugaaacaagauauaguagcaauaacugauuggucaggauauagcgggaguuuuguccagcauccagaacugacagguuuagauugcauaagaccuuguuucuggguugaguuaaucagagggcggcccaaagagaguacaaucuggacuagugggagcagcauauccuuuugugguguaaauagugacacugugaguuggucuuggccagacggugcugaguugccauucaccauugacaaguaa

SEQ ID NO: 51560 - RNA, 1350 nt, Artificial Sequence
  neuraminidase__InfluenzaA__AEO89084
augaauccaaaucagaagauaauaaccauugggucaaucuguaugguaauuggaauaguuagcuuaauguuacaaauugggaacaugaucucaauauggaucaguuauucaauucaaacagggaaucaacaccaagcugaaccaaccagaaaugcuacuuuucuuacugagaacgcuguggcuucaguaacauuagcgggcaauucaucucuuugccccguuagaggaugggcuguacacaguaaagacaacagcauaaggauugguuccaagggggauguguuuguuauuagagagccguucauuucaugcucccacuuggaaugcagaacuuucuuuuugacucagggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacaccaucaagaguuggaggaacaacauacugagaacucaagagucugaaugugcauguguaaauggcucuugcuuuacuguaaugacugauggaccaagugaugggcaggcaucauauaagaucuucaaaauggaaaaagggaaagugguuaaaucagucgaauugauugcuccuaauuaucacuaugaggaaugcuccuguuauccugaugcuggcgaaaucacaugugugugcagggauaauuggcacggcucgaauaggccauggguaucuuucaaucagaauuuggaguaucaaauaggauauauaugcaguggaguuuucggagacaauccacgccccaaugauggaacagguaguugugguccaguguccccuaacggggcauaugggauaaaaggguuuucauuuaaauacggcaaugguguuuggaucggaagaaccaaaagcacuaauuccaggagcggcuuugaaaugauuugggauccaaauggguggacugaaacggacaguaacuuuucggugaaacaagauauaguagcaauaacugauuggucaggauauagcgggaguuuuguccagcauccagaacugacaggauuagauugcauaagaccuugcuucuggguugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 51561 - RNA, 1350 nt, Artificial Sequence
  neuraminidase__InfluenzaA__AEO89093
augaauccgaaucagaagauaauaaccauugggucaaucuguaugguaauuggaauaguuagcuuaauguuacaaauugggaacaugaucucauuaugggucagucauucaauucagacagggaaucaacaccaaguugaaccaaucagcaauacuaauuuucuuguugagaaagcuguggcuucuguaacauuagcaggcaauucaucucuuugcccaauuagaggaugggcuguacacaguaaggacaacaguauaaggauugguuccaaaggggauguguuuguuauuagagagccauucaucucaugcucccacuuggaaugcagaacuuucuuuuugacccagggagccuugcugaaugacaagcauuccaauggaacugucaaagacaggagcccucacagaacauuaaugaguuguccugugggugaggcucccuccccauauaacucaagguucgaaucuguugcuuggucagcaagugcuugccaugauggcaccaguugguugacaauuggaauuucuggcccagacaauggggcuguggcuguauugaaauacaauggcaugauaacagacaccaucaagagcuggagaaacaacauacugagaacucaagagucugaaugugcauguguaaauggcucuugcuuuacuguaaugacugauggaccaaguaaugggcaggcaucauauaagaucuucaaaauggaaaaaggaagagugguuaaaucagucgaauuggaugcuccuaauuaccacuaugaggaaugcucauguuauccugaugccggcgaaaucacaugugugugcagggauaauuggcauggcucaaaucggccauggguaucuuucaaucaaaauuuggaguaucaaauaggcuauauaugcagcggaguuuuuggggacaauccacgccccaaugauggaacagguaguugugguccgguguccucuaauggggcauaugggguaaaaggguuuucauuuaaauacggcaaugguguuuggaucgggagaaccaaaagcccuaauuccaggagcggcuuugaaaugauuugggauccaaauggguggacugaaacggacaguagcuucucggugaaacaagauauaguagcaauaacugauuggucaggguauagcgggaguuuuguccagcauccagaacugacaggauuagauugcauaagaccuuguuucuggguugaguuaaucagagggcggcccaaagagagcacaauuuggacuagugggagcagcauauccuuuugugguguaaauagugacacugugaguuggucuuggccagacggugcugaguugccauucaccauugacaaguaa

SEQ ID NO: 51562 - RNA, 1350 nt, Artificial Sequence
  neuraminidase__InfluenzaA__AEO89102
augaauccaaaucaaaagauaauaaccauugggucaaucuguaugguaauuggaauaguuagcuuaauguuacaaauugggaacaugaucucaauauggaucagucauucaauucagacagggaaucaaaaccaaguugagccaaucagcaauacuaauuuucuuacugagaaagcuguggcuucaguaauauuagcgggcaauucaucucuuugcccuauuagaggaugggcuauacacaguaaggacaacaguauaaggauugguuccaagggggauguauuuguuauuagagagccauucaucucaugcucccacuuggaaugcagaacuuucuuuuugacucagggagccuugcugaaugacaagcacuccaacgggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccggacaguggggcuguggcuguauugaaauacaauggcauaauaacagacaccaucaagagcuggaggaacaacauacugagaacucaagaguccgaaugugcaugcguaaacggcucuugcuuuacuguaaugacugacggaccaaguaaugggcaggcaucuuauaagaucuucaaaauggaaaaagggaaaguaauuaaaucagucgaauuggaugcuccuaauuaccacuaugaggaaugcuccuguuauccugaugccggcgaaaucacaugugugugcagagauaauuggcauggcucaaaucggccauggguguccuucaaucaaaaucuggaauaucaaauaggauauauaugcaguggaguuuucggagacaauccacgccccaaugauggaacagguaguugugguccggugucccauaauggggcauaugggguaaaaggguuuucauuuaaauacggcaaugguguuuggaucgggagaaccaaaagcccuaauuccaggagcggcuuugaaaugauuugggauccaaauggguggagugaaacggacaguagcuucucggugaaacaagauauaguagcaauaacugauuggucaggauauagugggaguuuuguccagcauccagaacugacagguuuggauugcauaagaccuuguuucuggguugaguuaaucagagggcggcccaaagagaguacaguuuggacuagugguagcagcauauccuuuugugguguaaauagugacacugugaguuggucuuggccagacggugcugaguugccauucaccauugacaaguaa

SEQ ID NO: 51563 - RNA, 1350 nt, Artificial Sequence
  neuraminidase__InfluenzaA__AEO89111
augaauccaaaucagaagauaauaaccauugggucaaucuguaugguaauuggaauaguuagcuuaauguuacaaauugggaacauaaucucaauaugggucagucauucaauucaaacagggaaucaacaccaagaugaaccaaucagaaaugcuaauguucuuacugagaacgcuguggcuucaguaacauuagcgggcaauucaucucuuugccccguuagaggaugggcuguacacaguaaagacaacagcauaaggauugguuccaagggggauguguuuguuauuagagagccguucaucucaugcucccacuuggaaugcagaacuuucuuuuugacucagggagccuuacugaaugacaagcacuccaaugggacugucaaagacagaagcccucacagaacauuaaugagcuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacaccaucaagaguuggaggaacaacauacugagaacucaagagucugaaugugcauguguaaauggcucuugcuuuacuguaaugacugauggaccaaguaaugggcaggcaucauauaagaucuucaaaauggaaaaaggaaaagugguuaaaucagucgaauugaaugccccuaauuaucacuaugaggaaugcuccuguuauccugaugcuggugaaaucacaugugugugcagggauaauuggcauggcucaaauaggccauggguaucuuucaaucagaauuuggaguaucaaauaggauauauauguagcggaguuuucggagacaauccacgccccaaugauggaacagguaguugugauccaguguccccuaauggggcauaugggauaaaaggguuuuccuuuaaauacggcaaugguguuuggaucggaagaaccaaaagcacuaauuccaggagugguuuugaaaugauuugggauccaaauggguggacugaaacggacaguaacuuuucagugaaacaagauauaguagcaauaacugauuggucaggguauagcgggaguuuuguccagcauccagaacugacaggauuagauugcauaagaccuugcuucuggguugaguuaaucagagggcggcccaaagagagcacaauuuggacuagugggagcagcauaucuuuuugugguguaaauagcgacacugugaguuggucuuggccagacggugcugaguugccauucaccauugacaaguag

SEQ ID NO: 51564 - RNA, 1350 nt, Artificial Sequence
  neuraminidase__InfluenzaA__AEO89120
augaauccaaaucagaagauaauaaccauugggucaaucuguaugguaauuggaauaguuagcuuaauguuacaaauugggaacaugaucucaauaugggucagucauucaauucaaacagggaaucaacaccaagcugaaccaaucagaaaugcuaguuuucuuacugagaacgcuguggcuucaguaacauuagcgggcaauucaucccuuugccccguuagaggaugggcuguacacaguaaagacaacaguauaaggauugguuccaagggggauguguuuguuauuagagagccguucaucucaugcucccacuuggaaugcagaacuuucuuuuugacucagggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaucaguugguugacaauuggaauuucuggcccagacaauggggcuguggcuguauugaaauacaauggcauaauaacagacaccaucaagaguuggagaaacaacauacugagaacucaagagucugaaugugcauguguaaauggcucuugcuuuacuguaaugacugauggaccaaguaaugggcaggcaucauauaagaucuucaaaauggaaaaggggaaagugguuaaaucagucgaauugaaugcuccuaauuaucacuaugaggaaugcuccuguuauccugaugcuggcgaaaucacaugugugugcagggauaauuggcaugguucaaauaggccauggguaucuuucaaucagaauuuggaguaucaaauaggauauauaugcaguggaguuuucggagacaauccacgccccaaugauggaacagguaguugugguccaguguccccuaacggggcauaugggauaaaaggguuuucauuuaaauacggcaaugguguuuggaucggaagaaccaaaagcacuaauuccaggagcgguuuugaaaugauuugggauccaaaugggugggcugaaacggacaguaacuuuucggugaaacaagauauaguagcaauaacugauuggucaggauauagcgggaguuuuguccagcauccagaacuaacaggauuagauugcauaagaccuugcuucuggguugaguuaaucagagggcggcccaaagagggcacaauuuggacuagugggagcagcauauccuuuugugguguaaauagugacacugugaguuggucuuggccagacggugcugaguugccauucaccauugacaaguag

SEQ ID NO: 51565 - RNA, 1350 nt, Artificial Sequence
  neuraminidase__InfluenzaA__AEO89129
augaauccaaaucagaagauaauaaccauugggucaaucuguaugguaauuggaauaguuagcuuaauguuacaaauugggaacauaaucucaauaugggucagucauucaacucaaacagggaaucaacaccaagaugaaccaaucagaaaugcuaauuuucuuacugagaacgcuguggcuucaguaacauuagcgggcaauucaucucuuugccccguuagaggaugggcuguacacaguaaagacaacaguauaaggguugguuccaagggggauguguucguuauuagagagccguucaucucaugcucccacuuggaaugcagaacuuucuuuuugacucagggagcccuacugaacgacaagcacuccaaugggacugucaaagacagaagcccucacagaacauuaaugaguuguccugugggugaggcucccuccccauauaacucaagguuugagucuguugcuuggucagcaagugcuugccaugauggcacuaguugguugacaauuggaauuucuggcccagacaauggggcuguggcuguauugaaauacaauggcauaauaacagacaccaucaagaguuggaggaacaacauacugagaacucaagagucugaaugugcauguguaaauggcucuugcuuuacuguaaugacugauggaccaaguaaugggcaggcaucauauaagaucuucaaaauggaaaaaggaaaagugguuaaaucagucgaauugaaugcuccuaauuaucauuaugaggaaugcuccuguuauccugaugcuggcgaaaucacaugugugugcagggauaauuggcauggcucaaauaggccauggguaucuuucaaucagaauuuggaguaucaaauaggauauauauguaguggaguuuucggagacaauccacgccccaaugauggaacagguaguugugauccaguguccccuaacggggcauaugggauaaaaggguuuucauuuaaauacggcaaugguguuuggaucggaagaaccaaaagcacuaauuccaggagugguuuugagaugauuugggauccaaauggguggacugaaacggacaguaacuuuucagugaaacaagauauaguagcaauaacugauuggucaggguauagcgggaguuuuguccagcauccagaacugacaggauuagauugcauaagaccuugcuucuggguugaguuaaucagagggcggcccaaagagagcacaauuuggacuagugggagcagcauaucuuuuugugguguaaauagcgacacugugaguuggucuuggccagacggugcugaguugccauucaccauugacaaguag

SEQ ID NO: 51566 - RNA, 1350 nt, Artificial Sequence
  neuraminidase__InfluenzaA__AEO89138
augaauccaaaucaaaagauaauaaccauuggaucaaucuguaugguaacuggaauaguuagcuuaauguuacagauugggaacauaaucucaaugugggucagucauucaauucaaacaaggaaucaacaccaagcugaaccaaucagaaauacuaauuuucuuacugagaaugcuguggcuucaguaacauuaacgggcaauucgucucuuugccccauuagaggaugggcuguacacaguaaagacaacaguauaaggauugguuccaagggggauguguuuguaauuagagagccguucaucucaugcucccauuuggaaugcagaacuuucuuuuugacccagggagccuuacugaaugauaagcacuccaacgggacugucaaagacagaagcccucacagaacacuaaugaguugcccugugggugaggcucccuccccauauaacucaagguuugagucuguugcuuggucagcaagugcuugccaugauggcaccaguuggcugacaauuggaauuucugguccagacaauggggcgguggcuguauugaaauacaacggcauaauaacagacaccaucaagaguuggaggaacaauauacugagaacucaagagucugaaugugcauguguaaauggcucuugcuuuacuguaaugacugauggaccaaguaauggacaggcaucauauaagaucuucaaaauggaaaaagggaaaguaguuaaaucagucgaauugaaugcuccuaauuaucacuaugaggaaugcuccuguuauccugaugcuggagaaaucauaugugugugcagggauaauuggcauggcucaaauaggccauggguaucuuucaaucagaauuuggaguaucaaauaggauacauaugcaguggaguuuucggagacaauccacggcccaaugauggaacagguaguugugguccaguguccccuaacggggcauaugggauaaaaggguuuucauuuaaauacggcaaugguguuuggaucgggagaaccaaaagcacuaauuccaggagcggcuuugaaaugauuugggauccaaaugguuggacuggaacggacaaugacuuuucggugaaacaagauauaguagcaauaacugauuggucaggauauagcgggaguuuuguccagcauccagaacugacaggauuagauugcauaagaccuugcuucuggguugaguuaaucagagggcggcccaaagagagcacaguuuggacuagugggagcagcauaucuuuuugugguguaaauagugacacugugaguuggucuuggccagacggugcugaguugccauucaccauugacaaguag

SEQ ID NO: 51567 - RNA, 1350 nt, Artificial Sequence
  neuraminidase__InfluenzaA__AEO89156
augaauccaaaucaaaagauaauaaccauuggaucaaucuguaugguaacuggaauaguuagcuuaaugcuacagauugggaacauaaccucaaugugggucagucauucaauucaaacaaggaaucaacaccaagcugaaccaaucagaaauacuaauuuucuuacugagaacgcuguggcuucaguaacauuagcgggcaauucgucucuuugccccauuagaggaugggcuguacacaguaaagacaacaguauaaggauugguuccaagggggauguguuuguaauuagagagccguucaucucaugcucccacuuggaaugcagaacuuucuuuuugacccagggagcccuacugaaugacaagcacuccaacgggacugucaaagacagaagcccucacagaacacuaaugaguugcccugugggugaggcucccuccccauauaacucaagguuugagucuguugcuuggucagcaagugcuugccaugauggcaccaguuggcugacaauugggauuucugguccagacaauggggcgguggcuguauugaaauacaacggcauaauaacagacaccaucaaaaguuggaggaacaacauacugagaacucaagagucugaaugugcauguguaaauggcucuugcuuuacuguaaugacugauggaccaaguaauggacaggcaucauauaagaucuucaaaauggaaaaagggaaaguaguuaaaucagucgaauugaaugcuccuaauuaucacuaugaggaaugcuccuguuauccugaugcuggagaaaucauaugugugugcagggauaauuggcauggcucaaauaggccauggguaucuuucaaucagaauuuggaguaucaaauaggauacauaugcaguggaguuuucggagacaauccacgccccaaugauggaacagguaguugugguccaguguccccuaacggggcauaugggauaaaaggguuuucauuuaaauacggcaaugguguuuggaucgggagaaccaaaagcacuaauuccaggagcggcuuugaaaugauuugggauccaaaugguuggacuggaacggacagugacuuuucggugaaacaagauauaguagcaauaacugauuggucaggauauagcgggaguuuuguccagcauccagaacugacaggauuagauugcauaagaccuugcuucuggguugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 51568 - RNA, 1350 nt, Artificial Sequence
  neuraminidase__InfluenzaA__AEO89174
augaauccaaaucaaaagauaauaaccauuggaucaaucuguaugguaacuggaauaguuagcuuaaugcuacagauugggaacauaaucucaaugugggucagucauucaauucaaacaaggaaucaacaccaagcugaaccaaucagaaauacuaauuuucuuacugagaacgcuguggcuucaguaacauuagcgggcaauucgucucuuugccccauuagaggaugggcugugcacaguaaagacaacaguauaaggauugguuccaagggggauguguuuguaauuagagagccguucaucucaugcucccauuuggaaugcagaacuuucuuuuugacccagggagcauuacugaaugacaagcacuccaacgggacugucaaagacagaagcccucacagaacacuaaugaguugcccugugggugaggcucccuccccauauaacucaagguuugagucuguugcuuggucagcaagugcuugccaugauggcaccaguuggcugacaauuggaauuucugguccagacaauggggcgguggcuguauugaaauacaacggcauaauaacagacaccaucaagaguuggaggaacaacauacugagaacucaagagucugaaugugcauguguaaauggcucuugcuuuacuguaaugacugauggaccaaguaauggacaggcaucauauaagaucuucaaaauggaaaaagggaaaguagucaaaucagucgaauugaaugcuccuaauuaucacuaugaggaaugcuccuguuauccugaugcuggagaaaucauaugugugugcagggauaauuggcauggcucaaauaggccauggguaucuuucaaucagaauuuggaguaucaaauaggauacauaugcaguggaguuuucggagacaauccacgccccaaugauggaacagguaguugugguccaguguccccuaacggggcauaugggauaaaaggguuuucauuuaaauacggcaaugguguuuggaucgggagaaccaaaagcacuaauuccaggagcggcuuugaaaugauuugggauccaaaugguuggacuggaacggacagugacuuuucggugaaacaagauauaguagcaauaacugauuggucaggauauagcgggaguuuuguccagcauccagaacugacaggauuagauugcauaagaccuugcuucuggguugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 51569 - RNA, 1350 nt, Artificial Sequence
  neuraminidase__InfluenzaA__AEO89183
augaauccaaaucagaagauaguaaccauuggaucaaucuguaugguaauuggaauaguuagcuugauguuacagauugggaacaugaucucaauaugggucagucauucaauucaaacagggaaucaacaccaaacugaaccaaucagaaauacuaauuuucuuacugagaacacuguggcuucaguaacauuagcuggcaauucaucucuuugccccauuagaggaugggcuguacacaguaaagacaacaguauaaggauuggguccaaaggggauguguuuguaauuagagagccguucaucucaugcucccaucuggaaugcagaacuuucuuuuugacucagggagcuuuacugaaugacaagcacuccaacgggacugucaaagacaggagcccucacagaacgcuaaugaguuguccuauaggugaggcucccuccccauauaacucgagguuugagucuguugcuuggucggcaagugcuugccaugauggcaccaguugguugacaauuggaauuucugguccagacaauggggcuguggcgguauugaaauacaauggcauaauaacagacacuaucaagaguuggaggaauaacauacugaggacccaagagucugaaugugcauguguaaauggcucuugcuuuacugugaugacagauggaccaaguaauggacaggcaucauauaagauuuucaaaauggaaaaagggaaaguaguuaagucagucgaauugaaugcuccuaauuaucacuaugaggaaugcuccuguuauccugaugcuggcgaaaucauaugugugugcagggauaauuggcauggcucaaacaggccauggguaucuuucaaucagaauuuggaguaucaaauaggauauauuugcaguggaguuuucggagacaauccacgaccaaaugaugggaaagguaguugugguccaguguccccuaacggggcauaugggguaaaaggguuuucauuuaaauacggcaauggugucuggaucgggaggaccaaaagcacucauuccaggagcggcuuugaaaugauuugggauccaaauggguggacuggaacggacagugaauuuucgaugaaacaagauauaguagcaauaacugauuggucaggauauagcgggaguuuuguccagcacccagaacugacaggauuagauugcauaagaccuugcuucugggucgaguuaaucagagggcggcccaaggagagcacaauuuggacuagugggagcagcauaucuuuuugugguguaaauagugacacugugaguuggucuuggccagacggugcugaguugccauucaccauugacaaguag

SEQ ID NO: 51570 - RNA, 1350 nt, Artificial Sequence
  neuraminidase__InfluenzaA__AEO89205
augaauccaacucagaagauaauaaccauugggucaaucuguaugguaauuggaauaguuagcuuaauguuacaaauugggaacaugaucucaauaugggucagucauucaauucaaacagggaaucaacaccaagcugaaccaaucagaaaugcuaguuuucuuacugagaacgcuguggcuucaguaacauuagcgggcaauucaucccuuugccccguuagaggaugggcuguacacaguaaagacaacaguauaaggauugguuccaagggggauguguuuguuauuagagagccguucaucucaugcucccacuuggaaugcagaacuuucuuuuugacucagggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaucaguugguugacaauuggaauuucuggcccagacaauggggcuguggcuguauugaaauacaauggcauaauaacagacaccaucaagaguuggagaaacaacauacugagaacucaagagucugaaugugcauguguaaauggcucuugcuuuacuguaaugacugauggaccaaguaaugggcaggcaucauauaagaucuucaaaauggaaaaggggaaagugguuaaaucagucgaauugaaugcuccuaauuaucacuaugaggaaugcuccuguuauccugaugcuggcgaaaucacaugugugugcagggauaauuggcaugguucaaauaggccauggguaucuuucaaucagaauuuggaguaucaaauaggauauauaugcaguggaguuuucggagacaauccacgccccaaugauggaacagguaguugugguccaguguccccuaacggggcauaugggauaaaaggguuuucauuuaaauacggcaaugguguuuggaucggaagaaccaaaagcacuaauuccaggagcgguuuugaaaugauuugggauccaaaugggugggcugaaacggacaguaacuuuucggugaaacaagauauaguagcaauaacugauuggucaggauauagcgggaguuuuguccagcauccagaacuaacaggauuagauugcauaagaccuugcuucuggguugaguuaaucagagggcggcccaaagagggcacaauuuggacuagugggagcagcauauccuuuugugguguaaauagugacacugugaguuggucuuggccagacggugcugaguugccauucaccauugacaaguag

SEQ ID NO: 51571 - RNA, 1350 nt, Artificial Sequence
  neuraminidase__InfluenzaA__AEO89215
augaauccaaaucagaagauaauaaccauugggucaaucuguauggcaauuggaauaguuagcuuaauguuacaaauugggaacaugaucucaauaugggucagucauucaauucaaacagggaaucaacaccaagcugaaccaaucagaaaugcuaguuuucuuacugagaacgcuguggcuucaguaacauuagcgggcaauucaucccuuugccccguuagaggaugggcuguacacaguaaagacaacaguauaaggauugguuccaagggggauguguuuguuauuagagagccguucaucucaugcucccacuuggaaugcagaacuuucuuuuugacucagggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaucaguugguugacaauuggaauuucuggcccagacaauggggcuguggcuguauugaaauacaauggcauaauaacagacaccaucaagaguuggagaaacaacauacugagaacucaagagucugaaugugcauguguaaauggcucuugcuuuacuguaaugacugauggaccaaguaaugggcaggcaucauauaagaucuucaaaauggaaaaggggaaagugguuaaaucagucgaauugaaugcuccuaauuaucacuaugaggaaugcuccuguuauccugaugcuggcgaaaucacaugugugugcagggauaauuggcaugguucaaauaggccauggguaucuuucaaucagaauuuggaguaucaaauaggauauauaugcaguggaguuuucggagacaauccacgccccaaugauggaacagguaguugugguccaguguccccuaacggggcauaugggauaaaaggguuuucauuuaaauacggcaaugguguuuggaucggaagaaccaaaagcacuaauuccaggagcgguuuugaaaugauuugggauccaaaugggugggcugaaacggacaguaacuuuucggugaaacaagauauaguagcaauaacugauuggucaggauauagcgggaguuuuguccagcauccagaacuaacaggauuagauugcauaagaccuugcuucuggguugaguuaaucagagggcggcccaaagagggcacaauuuggacuagugggagcagcauauccuuuugugguguaaauagugacacugugaguuggucuuggccagacggugcugaguugccauucaccauugacaaguag

SEQ ID NO: 51572 - RNA, 1350 nt, Artificial Sequence
  neuraminidase__InfluenzaA__AEO89226
augaauccaacucagaagauaauaaccauugggucaaucuguauggcaauuggaauaguuagcuuaauguuacaaauugggaacaugaucucaauaugggucagucauucaauucaaacagggaaucaacaccaagcugaaccaaucagaaaugcuaguuuucuuacugagaacgcuguggcuucaguaacauuagcgggcaauucaucccuuugccccguuagaggaugggcuguacacaguaaagacaacaguauaaggauugguuccaagggggauguguuuguuauuagagagccguucaucucaugcucccacuuggaaugcagaacuuucuuuuugacucagggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaucaguugguugacaauuggaauuucuggcccagacaauggggcuguggcuguauugaaauacaauggcauaauaacagacaccaucaagaguuggagaaacaacauacugagaacucaagagucugaaugugcauguguaaauggcucuugcuuuacuguaaugacugauggaccaaguaaugggcaggcaucauauaagaucuucaaaauggaaaaggggaaagugguuaaaucagucgaauugaaugcuccuaauuaucacuaugaggaaugcuccuguuauccugaugcuggcgaaaucacaugugugugcagggauaauuggcaugguucaaauaggccauggguaucuuucaaucagaauuuggaguaucaaauaggauauauaugcaguggaguuuucggagacaauccacgccccaaugauggaacagguaguugugguccaguguccccuaacggggcauaugggauaaaaggguuuucauuuaaauacggcaaugguguuuggaucggaagaaccaaaagcacuaauuccaggagcgguuuugaaaugauuugggauccaaaugggugggcugaaacggacaguaacuuuucggugaaacaagauauaguagcaauaacugauuggucaggauauagcgggaguuuuguccagcauccagaacuaacaggauuagauugcauaagaccuugcuucuggguugaguuaaucagagggcggcccaaagagggcacaauuuggacuagugggagcagcauauccuuuugugguguaaauagugacacugugaguuggucuuggccagacggugcugaguugccauucaccauugacaaguag

SEQ ID NO: 51573 - RNA, 1350 nt, Artificial Sequence
  neuraminidase__InfluenzaA__AEO89237
augaauccaaaucaaaagauaauaaccauuggaucaaucuguaugguaauuggaauaguuagcuuaauguuacagauugggaacauaaucucaaugugggucagucauucaauucaaacaaggaaucaacaccaagcugaaccaaucagaaauacuaauuuucuuacugagaacgcuguggcuucaguaacauuagcgggcaauucgucucuuugccccauuagaggaugggcuguacacaguaaagacaacaguauaaggauugguuccaagggggauguguuuguaauuagagagccguucaucucaugcucccauuuggaaugcagaacuuucuuuuugacccagggagccuuacugaaugacaagcacuccaacgggacugucaaagacagaagcccucacagaacacuaaugaguugcccugugggugaggcucccuccccauauaacucaagguuugagucuguugcuuggucagcaagugcuugccaugauggcaccaguuggcugacaauuggaauuucugguccagacaauggggcgguggcuguauugaaauacaacggcauaauaacagacaccaucaagaguuggaggaacaacauacugagaacucaagagucugaaugugcauguguaaauggcucuugcuuuacuguaaugacugauggaccaaguaauggacaggcaucauauaagaucuucaaaauggaaaaagggaaaguaguuaaaucagucgaauugaaugcuccuaauuaucacuaugaggaaugcuccuguuauccugaugcuggagaaaucauaugugugugcagggauaauuggcauggcucaaauaggccauggguaucuuucaaucagaauuuggaguaucaaauaggauauauaugcaguggaguuuucggagacaauccacgccccaaugauggaacagguaguugugguccaguguccccuaacggggcauaugggauaaaaggguuuucauuuaaauacggcaaugguguuuggaucgggagaaccaaaagcacuaauuccaggagcggcuuugaaaugauuugggauccaaauggguggacuggaacggacagugacuuuucggugaaacaagauauaguagcaauaacugauuggucaggauauagcgggaguuuuguccagcauccagaacugacaggauuagauugcauaagaccuugcuucuggguugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 51574 - RNA, 1350 nt, Artificial Sequence
  neuraminidase__InfluenzaA__AEO89248
augaauccaaaucaaaagauaauaaccauuggaucaaucuguaugguaauuggaauaguuagcuuaauguuacagauugggaacauaaucucaauaugggucagucauucauuucaaacaaggguucaacaccaagcugaaccaaucagaaauacuaauuuucuuacugagaacgcuguggcuucaguaacauuagcgggcaauucgucucuuugccccauuaggggaugggcuguacacaguaaagacaacaguauaagaauugguuccaagggggauguguuuguaauuagagagccguucaucucaugcucucauuuggaaugcagaacuuucuuuuugacccagggagccuuacugaaugacaagcacuccaacgggacugucaaagacaggagcccucacagaacacuaaugaguugcccugugggugaggcucccuccccauauaacucaagguuugagucuguugcuuggucagcaagugcuugccaugauggcaccaguuggcugacaauuggaauuucuggaccagacaauggggcuguggcuguauugaaauacaauggcauaauaacagacaccaucaagaguuggaggaacaacauacugagaacucaagagucugaaugugcauguguaaauggcucuugcuuuacuguaaugacugauggaccaaguaauggacaggcaucauauaagaucuucaaaaugaaaaaagggaaaguaguuaaaucagucgaguugaaugcuccuaauuaucacuaugaggaaugcuccuguuauccugaugcuggagaaaucauaugugugugcagggauaauuggcauggcucaaauaggccauggguaucuuucaaucagaauuuggaguaucaaauaggauauauaugcaguggaguuuucggagacaauccacgccccaaugauggaacagguaguuguggcccaguguccccuaacggggcauaugggauaaaaggguuuucauuuaaauacggcaauggcguuuggaucgggagaaccaaaagcacuaauuccagaagcggcuuugaaaugauuugggauccaaauggguggacuggaacggacagugacuuuucgaugaaacaagauauaguagcaauaacugauuggucaggauauagcgggaguuuuguccagcauccagaacugacaggauuagauugcauaagaccuugcuucuggguugaguuaaucagagggcggcccaaagaaagcacaauuuggacuagugggagcagcauauccuuuugugguguaaauagugacacugugaguuggucuuggccagacggugcugaguugccauucaccauugacaaguag

SEQ ID NO: 51575 - RNA, 1350 nt, Artificial Sequence
  neuraminidase__InfluenzaA__AEO89270
augaauccaaaucaaaagauaauaaccauuggaucaaucuguaugguaacuggaauaguuagcuuaaugcuacagauugggaacauaaccucaaugugggucagucauucaauucaaacaaggaaucaacaccaagcugaaccaaucagaaauacuaauuuucuuacugagaacgcuguggcuucaguaacauuagcgggcaauucgucucuuugccccauuagaggaugggcuguacacaguaaagacaacaguauaaggauugguuccaagggggauguguuuguaauuagagagccguucaucucaugcucccacuuggaaugcagaacuuucuuuuugacccagggagccuuacugaaugacaagcacuccaacgggacugucaaagacagaagcccucacagaacacuaaugaguugcccugugggugaggcucccuccccauauaacucaagguuugagucuguugcuuggucagcaagugcuugccaugauggcaccaguuggcugacaauugggauuucugguccagacaauggggcgguggcuguauugaaauacaacggcauaauaacagacaccaucaaaaguuggaggaacaacauacugagaacucaagagucugaaugugcauguguaaauggcucuugcuuuacuguaaugacugauggaccaaguaauggacaggcaucauauaagaucuucaaaauggaaaaagggaaaguaguuaaaucagucgaauugaaugcuccuaauuaucacuaugaggaaugcuccuguuauccugaugcuggagaaaucauaugugugugcagggauaauuggcauggcucaaauaggccauggguaucuuucaaucagaauuuggaguaucaaauaggauacauaugcaguggaguuuucggagacaauccacgccccaaugauggaacagguaguugugguccaguguccccuaacggggcauaugggauaaaaggguuuucauuuaaauacggcaaugguguuuggaucgggagaaccaaaagcacuaauuccaggagcggcuuugaaaugauuugggauccaaaugguuggacuggaacggacagugacuuuucggugaaacaagauauaguagcaauaacugauuggucaggauauagcgggaguuuuguccagcauccagaacugacaggauuagauugcauaagaccuugcuucuggguugaguuaaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 51576 - RNA, 1350 nt, Artificial Sequence
  neuraminidase__InfluenzaA__AEO89281
augaauccaaaucagaagauaauaaccauuggaucaaucuguaugguaguuggaauaguuagcuuaaugcuacagauugggaacauagucucaauaugggucagucauucaauucaaacagggcaucaacaacaagcugaaccaaucaaaaauacuaauuuucuuacuaagaacgcuguggcuucaguaacauuagcgggcaauucaucucuuugccccauuagaggaugggcuguacacaguaaagacaacaguauaaggauugguuccaagggggauguguuuguaauuagagagccauucaucucaugcucccauuuggaaugcagaacuuucuuuuugacucagggagcuuuacuaaaugacaagcacuccaacgggacugucaaagacagaagcccucacagaacacuaaugaguuguccugugggugaggcucccuccccauauaacucaagguuugagucuguugcuuggucagcaagugcuugccaugauggcaccaguugguugacaauuggaauuucugguccagacaauggagcuguggcuguauugaaauacaauggaauaauaacagacaccaucaagaguuggaggaacaacacacugagaacccaagagucugaaugugcauguguaaauggcucuugcuuuacuguaaugacugauggaccaaguaauggacaggcaucauauaagaucuucaaaauggaaaaaggaaaaguaguuaaaucagccgaauuaaaugcuccuaauuaucacuaugaggaaugcuccuguuauccugaugcuggcgaaaucauaugugugugcagagauaauuggcauggcucaaauaggccauggguaucuuucaaucagaauuuggaguaucaaauaggauauauaugcaguggaguuuucggagacaacccacgucccaaugauggaacagguaguugcgguccaguguccccuaacggggcauaugggauaaaaggguuuucauucaaauacggcaaugguguuuggaucgggagaaccaaaagcacuaauuccaggagcggcuuugaaaugauuugggacccaaauggguggacuggaacggacaguaacuuuucgaugaaacaagauauaguagcaauaacugaguggucaggauauagcgggaguuuuguccagcauccagaacugacaggauuagauugcauaagaccuugcuucugggucgaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 51577 - RNA, 1350 nt, Artificial Sequence
  neuraminidase__InfluenzaA__AEO89291
augaauccaaaucagaagauaauaaccauuggaucaaucuguaugguaguuggaauaguuagcuuaaugcuacagauugggaacauagucucaauaugggucagucauucaauucaaacagggcaucaacaacaagcugaaccaaucaaaaauacuaauuuucuuacugagaacgcuguggcuucaguaacauuagcgggcaauucaucucuuugccccauuagaggaugggcuguacacaguaaagacaacaguauaaggauugguuccaagggggauguguuuguaauuagagagccauucaucucaugcucccauuuggaaugcagaacuuucuuuuugacucagggagcuuuacuaaaugacaagcacuccaacgggacugucaaagacagaagcccucacagaacacuaaugaguuguccugugggugaggcucccuccccauauaacucaagguuugagucuguugcuuggucagcaagugcuugccaugauggcaccaguugguugacaauuggaauuucugguccagacaauggagcuguggcuguauugaaauacaauggaauaauaacagacaccaucaagaguuggaggaacaacauacugagaacccaagagucugaaugugcauguguaaauggcucuugcuuuacuguaaugacugauggaccaaguaauggacaggcaucauauaagaucuucaaaauggaaaaaggaaaaguaguuaaaucagccgaauuaaaugcuccuaauuaucacuaugaggaaugcuccuguuauccugaugcuggugaaaucauaugugugugcagagauaauuggcauggcucaaauaggccauggguaucuuucaaucagaauuuggaguaucaaauaggauauauaugcaguggaguuuucggagacaacccacgccccaaugauggaacagguaguugugguccaguguccccuaacggggcauaugggauaaaaggguuuucauucaaauacggaaaugguguuuggaucgggagaaccaaaagcacuaauuccaggagcggcuuugaaaugauuugggacccaaauggguggacuggaacggacaguaacuuuucgaugaaacaagacauaguagcaauaacugaguggucaggauauagcgggaguuuuguccagcauccagaacugacaggauuagauugcauaagaccuugcuucuggguugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 51578 - RNA, 1350 nt, Artificial Sequence
  neuraminidase__InfluenzaA__AEO89302
augaauccaaaucagaagauaauaaccauugggucaaucuguaugguaauuggaauaguuagcuuaauguuacaaauugggaacauaaucucaauaugggucagucauucaauucaaacagggaaucaacaccaagaugaaccaaucagaaaugcuaauuuucuuacugagaacgcuguggcuucaguaacauuagcgggcaauucaucucuuugccccguuagaggaugggcuguacacagcaaagacaacaguauaaggauagguuccaagggggauguguuuguuauuagagagccguucaucucaugcucccacuuggaaugcagaacuuucuuuuugacucagggagccuuacugaaugacaagcacuccaaugggacuguuaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacaccaucaagaguuggaggaacaacauacugagaacucaagagucugaaugugcauguguaaauggcucuugcuuuacuguaaugacugaugggccaaguaaugggcaggcaucauauaagaucuucaaaauggaaaaaggaaaagugguuagaucagucgaauugaaugccccuaauuaucacuaugaggaaugcuccuguuauccugaugcuggcgaaaucacaugugugugcagggauaauuggcauggcucaaauaggccauggguaucuuucaaucagaauuuggaguaucaaauaggauauauauguaguggaguuuucggagacaauccacgccccaaugauggaacagguaguugugauccaguguccccuaacggggcauaugggauaaaaggguuuucauuuaaauacggcaaugguguuuggaucggaagaaccaaaagcacuaauuccaggagugguuuugaaaugauuugggauccaaauggguggacugaaacggacagugacuuuucagugaaacaagauauaguagcaauaacugauuggucaggguauagcgggaguuuuguccagcauccagaacugacaggauuagauugcauaaggccuugcuucuggguugaguuaaucagagggcggcccaaagagagcacaauuuggacuagugggagcagcauaucuuuuugugguguaaguagcgacacugugaguuggucuuggccagacggugcugaguugccauucaccauugacaaguag

SEQ ID NO: 51579 - RNA, 1410 nt, Artificial Sequence; identical to SEQ ID NO: 46561
  neuraminidase__InfluenzaA__AEO99218

SEQ ID NO: 51580 - RNA, 1410 nt, Artificial Sequence
  neuraminidase__InfluenzaA__AEQ49739
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaagucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggauggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51581 - RNA, 1410 nt, Artificial Sequence
  neuraminidase__InfluenzaA__AEQ49740
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51582 - RNA, 1410 nt, Artificial Sequence
  neuraminidase__InfluenzaA__AEQ49741
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugacaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggauggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51583 - RNA, 1410 nt, Artificial Sequence
  neuraminidase__InfluenzaA__AEQ49742
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauacacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucguacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggauggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51584 - RNA, 1410 nt, Artificial Sequence
  neuraminidase__InfluenzaA__AEQ49743
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacagaagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcaugugugaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagacaucguaggaacaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaauuaa

SEQ ID NO: 51585 - RNA, 1410 nt, Artificial Sequence
  neuraminidase__InfluenzaA__AEQ49744
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugguaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauuuagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccaggaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaaaauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51586 - RNA, 1410 nt, Artificial Sequence
  neuraminidase__InfluenzaA__AEQ49745
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggauggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51587 - RNA, 1410 nt, Artificial Sequence
  neuraminidase__InfluenzaA__AEQ49746
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggauggauuguauaagaccuugcuucuggguugaacuaaucagagggcgacccaaagagaacacaaucuggacuagcgggagcagcauauccuuuugugguguaaacagugacacuguggguuggucuuggccagacggcgcugaguugccauuuaccauugacaaguaa

SEQ ID NO: 51588 - RNA, 1410 nt, Artificial Sequence; identical to SEQ ID NO: 51586
  neuraminidase__InfluenzaA__AEQ49747

SEQ ID NO: 51589 - RNA, 1410 nt, Artificial Sequence; identical to SEQ ID NO: 51223
  neuraminidase__InfluenzaA__AEQ49748

SEQ ID NO: 51590 - RNA, 1410 nt, Artificial Sequence
  neuraminidase__InfluenzaA__AEQ49749
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacacuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggauggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51591 - RNA, 1410 nt, Artificial Sequence
  neuraminidase__InfluenzaA__AEQ49750
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaccauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaaacauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51592 - RNA, 1410 nt, Artificial Sequence
  neuraminidase__InfluenzaA__AEQ49751
augaauccaaaccaaaagauaauaaccauugguucggucuguaugacaauuggaauggcuaacuuaauauuacaaauuggaaacauaaucucaauauggauuagccacucauuucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaccauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggcuucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggauggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51593 - RNA, 1410 nt, Artificial Sequence
  neuraminidase__InfluenzaA__AEQ49752
augaauccaaaccaaaagauaauaaccauugguucggucuguaugacaauuggaauggcuaacuuaauauuacaaauuggaaacauaaucucaauauggauuagccacucaauucaacuugggaaucaaagucagauuggaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcuccccuuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggauggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51594 - RNA, 1410 nt, Artificial Sequence
  neuraminidase__InfluenzaA__AEQ49753
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucggccgugggugucuuucaaccagaaucuggaauaucagauaggauacauaugcagugggauuuucggagacaauccgcgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggauggauuguauaagaccuugcuucuggguugaacuaaucagagggcgacccaaagagaacacaaucuggacuagcgggagcagcauauccuuuugugguguaaacagugacacuguggauuggucuuggccagacggugcugaguugccauuuaccauugacaaguaa

SEQ ID NO: 51595 - RNA, 1410 nt, Artificial Sequence
  neuraminidase__InfluenzaA__AEQ49754
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaauaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugagaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacaguaacacuguggguuggucuuggccagacggugcugaguugccauuuaccauugacaaguaa

SEQ ID NO: 51596 - RNA, 1410 nt, Artificial Sequence; identical to SEQ ID NO: 51586
  neuraminidase__InfluenzaA__AEQ49755

SEQ ID NO: 51597 - RNA, 1410 nt, Artificial Sequence
  neuraminidase__InfluenzaA__AEQ49756
augaauccaaaccaaaagauaauaaccauugguucggucuguaugacaauuggaauggcuaacuuaauauuacaaauuggaaacauaaucucaauauggauuagccacucaauucaacuugggaaucaaagucagguugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaauagugacacuguggguuggucuuggccagacggugcugaguugccauuuaccauugacaaguaa

SEQ ID NO: 51598 - RNA, 1410 nt, Artificial Sequence; identical to SEQ ID NO: 51586
  neuraminidase__InfluenzaA__AEQ49757

SEQ ID NO: 51599 - RNA, 1410 nt, Artificial Sequence
  neuraminidase__InfluenzaA__AEQ49758
augaauccaaaccaaaagauaauaaccauugguucggucuguaugacaauuggaauggcuaacuuaauauuacaaauuggaaacauaaucucaauauggauuagccacucaauucaacuugggaaucauagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuagcucaagaaaagguuuugagaugauuugggauccaaacggaugggcugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51600 - RNA, 1410 nt, Artificial Sequence; identical to SEQ ID NO: 51586
  neuraminidase__InfluenzaA__AEQ49759

SEQ ID NO: 51601 - RNA, 1410 nt, Artificial Sequence
  neuraminidase__InfluenzaA__AEQ49760
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggauggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51602 - RNA, 1410 nt, Artificial Sequence
  neuraminidase__InfluenzaA__AEQ49761
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuugguuaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccucggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaauaagagggcgauccaaagagaacacaaucuggacuagcgggagcagcauauccuuuugugguguaaacagugacacuguggguuggucuuggccagacggugcugaguugccauuuaccauugacaaguaa

SEQ ID NO: 51603 - RNA, 1410 nt, Artificial Sequence
  neuraminidase__InfluenzaA__AEQ49762
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggauaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucaugcuuuaucauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51604 - RNA, 1410 nt, Artificial Sequence
  neuraminidase__InfluenzaA__AEQ49763
augaauccaaaccaaaagauaauaaccauugguucggucuguaugacaauuggaauggcuaacuuaauauuacaaauuggaaauauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggauggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51605 - RNA, 1410 nt, Artificial Sequence; identical to SEQ ID NO: 51604
  neuraminidase__InfluenzaA__AEQ49764

SEQ ID NO: 51606 - RNA, 1410 nt, Artificial Sequence; identical to SEQ ID NO: 51604
  neuraminidase__InfluenzaA__AEQ49765

SEQ ID NO: 51607 - RNA, 1410 nt, Artificial Sequence
  neuraminidase__InfluenzaA__AEQ49766
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuaacgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51608 - RNA, 1410 nt, Artificial Sequence
  neuraminidase__InfluenzaA__AEQ49767
augaauccaaaccaaaagauaauaaccauugguucggucuguaugacaauuggaauggcuaacuuaauauuacaaauuggaaacauaaucucaauauggauuagccacucaauucaacuugggaaccaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucaaaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauacaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggauggguuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51609 - RNA, 1410 nt, Artificial Sequence
  neuraminidase__InfluenzaA__AEQ49768
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggaauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51610 - RNA, 1410 nt, Artificial Sequence; identical to SEQ ID NO: 51586
  neuraminidase__InfluenzaA__AEQ49769

SEQ ID NO: 51611 - RNA, 1410 nt, Artificial Sequence
  neuraminidase__InfluenzaA__AEQ49770
augaauccaaaccaaaagauaauaaccauugguucggucuguaugacaauuggaauggcuaacuuaauauuacaaauuggaaacauaaucucaguauggauuagccacucaauucaacuugggaaucaaaaucagacugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcuccccuuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugaugguaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucggauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucauaggaauaaaugaguggucaggauauagcgggaguuuuguucagcauccagaacuaacagggcuggauuguauaagaccuugcuucuggguugaacuaaucagagggcggcccaaagagaacacaaucuggacuagcgggagcagcauauccuuuugugguguaaacagugacacuguggguuggucuuggccagacggugcugaguugccauuuaccguugacaaguaa

SEQ ID NO: 51612 - RNA, 1410 nt, Artificial Sequence
  neuraminidase__InfluenzaA__AEQ49771
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaauaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugacagauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacaguaacacuguggguuggucuuggccagacggugcugaguugccauuuaccauugacaaguaa

SEQ ID NO: 51613 - RNA, 1410 nt, Artificial Sequence
  neuraminidase__InfluenzaA__AEQ49772
augaauccaaaccaaaagauaauaaccauugguucagucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaacuauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51614 - RNA, 1410 nt, Artificial Sequence
  neuraminidase__InfluenzaA__AEQ49773
augaauccaaaccaaaagauaauaaccauugguucgaucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaauaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacaguaacacuguggguuggucuuggccagacggugcugaguugccauuuaccauugacaaguaa

SEQ ID NO: 51615 - RNA, 1410 nt, Artificial Sequence
  neuraminidase__InfluenzaA__AEQ49774
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaauacaacacuuggguaaaucagacauauauuaacaucagcaacaccaacuuugcugcuggacagucagugguuuccgugaaauuagugggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauacugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuaugagaugauuugggauccaaacggauggacugggacagacaauaacuucucaauaaagcaagauaucguaggaauaaaugaguggucaggauauagcgggaguuuuguucagcauccagaacuaacagggauggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51616 - RNA, 1410 nt, Artificial Sequence; identical to SEQ ID NO: 51581
  neuraminidase__InfluenzaA__AEQ49775

SEQ ID NO: 51617 - RNA, 1410 nt, Artificial Sequence
  neuraminidase__InfluenzaA__AEQ49776
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccucggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacuggaacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccacagagaacacaauuuggacuagcgggagcagcauauccuuuugugguguaaacagugacacuguggguuggucuuggccagacggugcugaguugccauuuaccauugacaaguaa

SEQ ID NO: 51618 - RNA, 1410 nt, Artificial Sequence
  neuraminidase__InfluenzaA__AEQ49777
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacuggaacagacaauaacuucucaauaaagcaagauaucguaggaauaaaugaguggucaggauauagcgggaguuuuguucagcauccagaacuaacagggauggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51619 - RNA, 1410 nt, Artificial Sequence
  neuraminidase__InfluenzaA__AEQ49778
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggauaaaucagacauauguuaacaucagcaacaccaacuuugcugcuguacagucagugguuuccgugaaauuagcgggcaauuccacucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuagcucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51620 - RNA, 1410 nt, Artificial Sequence
  neuraminidase__InfluenzaA__AEQ49779
augaauccaaaccaaaagauaauaaccauugguucggucuguaugacaauuggaauggcuaacuuaauauuacaaauuggaaacauaaucucaauauggauuagccacucaauucaacuugggaaucaaaaucagacugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcuccccuuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugaugguaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucggauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucauaggaauaaaugaguggucaggauauagcgggaguuuuguucagcauccagaacuaacagggcuggauuguauaagaccuugcuucuggguugaacuaaucagagggcggcccaaagagaacacaaucuggacuagcgggagcagcauauccuuuugugguguaaacagugacacuguggguuggucuuggccagacggugcugaguugccauuuaccguugacaaguaa

SEQ ID NO: 51621 - RNA, 1410 nt, Artificial Sequence; identical to SEQ ID NO: 51581
  neuraminidase__InfluenzaA__AEQ49780

SEQ ID NO: 51622 - RNA, 1410 nt, Artificial Sequence
  neuraminidase__InfluenzaA__AEQ49781
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauuuauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51623 - RNA, 1410 nt, Artificial Sequence; identical to SEQ ID NO: 51590
  neuraminidase__InfluenzaA__AEQ49782

SEQ ID NO: 51624 - RNA, 1410 nt, Artificial Sequence
  neuraminidase__InfluenzaA__AEQ49783
augaauccaaaccaaaagauaauaaccauugguucggccuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucaaacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51625 - RNA, 1410 nt, Artificial Sequence
  neuraminidase__InfluenzaA__AEQ49785
augaauccaaaccaaaagauaauaacgauuggcucuguuucccucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugucccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacaaggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggacgauaaaaaugcaacugcuagcuucauuuacaaugggaggcuuguagauaguguuguuucaugguccaaagaaauccucaggacucaggagucagaaugcguuuguaucaauggaacuuguacaguaguaaugacugaugggagugcuucaggaaaagcugauacuaaaauacuauucaucgaggaggggaaaaucguucauacuagcacauugucaggaagugcucaacaugucgaggagugcuccugcuauccucgauauccuggugucagaugugucugcagagacaacuggaaaggcuccaauaggcccaucguagauauaaacaugaaggaucauagcauuguuuccaguuauguguguucaggacuuguuggagacacacccagaaaaaacgacagcuccagcaguagccauuguuuugauccuaacgaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauaaggggaaguaaagaggaaacugaaguauuguggaccucaaacaguauuguuguguuuuguggcaccucagggacauauggaacaggcucauggccugauggggcggacaucaaucucaugccuauauaa

SEQ ID NO: 51626 - RNA, 1410 nt, Artificial Sequence
  neuraminidase__InfluenzaA__AEQ49786
augaauccaaaccaaaagauaauaacgauuggcucuguuucccucaccauuuccacaauaugcuucuucaugcaaauugccaucuugauaaccacuguaacauugcauuucaagcaauaugaauucaacucccccccaaacaaccaagugaugcugugugaaccaacaauaauagaaagaaacauaacagagauaguguaucugaccaacaccaccauagagaaggaaauaugucccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacaaggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggacgauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucaucgaggaggggaaaaucguucauacuagcacauugucaggaagugcucaacaugucgaggagugcuccugcuauccucgauauccuggugucagaugugucugcagagacaacuggaaaggcuccaauaggcccaucguagauauaaacaugaaggaucauagcauuguuuccaguuauguguguucaggacuuguuggagacacacccagaaaaaacgacagcuccagcaguagccauuguuuugauccuaacgaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauaaggggaaguaaagaggaaacugaaguauuguggaccucaaacaguauuguuguguuuuguggcaccucagggacauauggaacaggcucauggccugauggggcggacaucaaucucaugccuauauaa

SEQ ID NO: 51627 - RNA, 1410 nt, Artificial Sequence; identical to SEQ ID NO: 51625
  neuraminidase__InfluenzaA__AEQ49788

SEQ ID NO: 51628 - RNA, 1410 nt, Artificial Sequence; identical to SEQ ID NO: 51625
  neuraminidase__InfluenzaA__AEQ49789

SEQ ID NO: 51629 - RNA, 1410 nt, Artificial Sequence
  neuraminidase__InfluenzaA__AEQ49790
augaauccaaaucaaaagauaauaacgauuggcucuguuucucucaccauuuccacaauaugcuucuucaugcaaauugccaucuugauaacuacuguaacauugcauuucaagcaauaugaauucuacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugguaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuaugugugcucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51630 - RNA, 1410 nt, Artificial Sequence
  neuraminidase__InfluenzaA__AEQ49791
augaauccaaaucaaaagauaauaacgauuggcucuguuucucucaccauuuccacaauaugcuucuucaugcaaauugccaucuugauaacuacuguaacauugcauuucaagcaauaugaauucuacccccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacguaauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuaugugugcucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51631 - RNA, 1410 nt, Artificial Sequence
  neuraminidase__InfluenzaA__AEQ49792
augaauccaaaccaaaagauaauaacgauuggcucuguuucccucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacaaggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggacgauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucaucgaggaggggaaaaucguucauacuagcacacugucaggaagugcucaacaugucgaggagugcuccugcuauccucgauauccuggugucagaugugucugcagagacaacuggaaaggcuccaauaggcccaucguagauauaaacaugaaggaucauagcauuguuuccaguuauguguguucaggacuuguuggagacacacccagaaaaaacgacagcuccagcaguagccauuguuuugauccuaacgaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauaaggggaaguaaagaggaaacugaaguauuguggaccucaaacaguauuguuguguuuuguggcaccucagggacauauggaacaggcucauggccugauggggcggacaucaaucucaugccuauauaa

SEQ ID NO: 51632 - RNA, 1410 nt, Artificial Sequence; identical to SEQ ID NO: 51631
  neuraminidase__InfluenzaA__AEQ49793

SEQ ID NO: 51633 - RNA, 1410 nt, Artificial Sequence; identical to SEQ ID NO: 51631
  neuraminidase__InfluenzaA__AEQ49794

SEQ ID NO: 51634 - RNA, 1410 nt, Artificial Sequence; identical to SEQ ID NO: 51631
  neuraminidase__InfluenzaA__AEQ49795

SEQ ID NO: 51635 - RNA, 1410 nt, Artificial Sequence
  neuraminidase__InfluenzaA__AEQ49796
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccgacaauaauagaaaggaacauaacagagauaguguaucugaccaacaccaccauagagaaggaaauaugccccaaauuagcagaauacagaaauuggucaaaaccgcaaugugacauuacaggauuugcaccuuuuucuaaggacaauucaauuaggcuuuccgcugguggggacaucugggugacaagagaaccuuaugugucaugcgauccugacaaguguuaucaauuugcccuuggacagggaacaacacuaaacaacgugcauucaaauaacacaguacgugguaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcaagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauaguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuugggguaugaaaccuucaaagucauugaaggcugguccaacccuaaguccaaauugcagauaaauaggcaagucauaguugacaaagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcugaccucaaucucaugccuauauaa

SEQ ID NO: 51636 - RNA, 1410 nt, Artificial Sequence; identical to SEQ ID NO: 51631
  neuraminidase__InfluenzaA__AEQ49797

SEQ ID NO: 51637 - RNA, 1410 nt, Artificial Sequence; identical to SEQ ID NO: 51631
  neuraminidase__InfluenzaA__AEQ49798

SEQ ID NO: 51638 - RNA, 1410 nt, Artificial Sequence; identical to SEQ ID NO: 51631
  neuraminidase__InfluenzaA__AEQ49799

SEQ ID NO: 51639 - RNA, 1410 nt, Artificial Sequence; identical to SEQ ID NO: 51631
  neuraminidase__InfluenzaA__AEQ49800

SEQ ID NO: 51640 - RNA, 1410 nt, Artificial Sequence; identical to SEQ ID NO: 51631
  neuraminidase__InfluenzaA__AEQ49801

SEQ ID NO: 51641 - RNA, 1410 nt, Artificial Sequence; identical to SEQ ID NO: 51631
  neuraminidase__InfluenzaA__AEQ49802

SEQ ID NO: 51642 - RNA, 1410 nt, Artificial Sequence
  neuraminidase__InfluenzaA__AEQ49803
augaauccaaaucaaaagauaauaacgauuggcucuguuucccucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaaugugacauuacaggauuugcaccuuuuucuaaggacaauucaauuaggcuuuccgcugguggggacaucugggugacaagagaaccuuaugugucaugcgauccuaacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcaagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucaacaugucgaggagugcucuugcuauccucgauauccuggugucagaugugucugcagagacaacuggaaaggcuccaauaggcccaucguagauauaaacauaaaggaucauagcauaguuuccaguuauguguguucaggacuuguuggagacacacccagaaaaaacgacagcaccagcaguagccauuguuuggauccuaacaaugaagaagguggucauggagugaaaggcugggccuuugaugauggaaaugacguguggaugggaagaacaaucagcgagacgucacgcuugggguaugaaaccuucaaagucauugaaggcugguccaacccuaaguccaaauugcagauaaauaggcaagucauaguugacaaagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcugaccucaaucucaugacuauauaa

SEQ ID NO: 51643 - RNA, 1410 nt, Artificial Sequence
  neuraminidase__InfluenzaA__AEQ49804
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcuaugugaaccaacaauaauagaaagaaacauaacagagauaguguaucugaccaacaccaccauagagaaggaaauaugccccaaaccagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaauuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacauuaucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucgcguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51644 - RNA, 1410 nt, Artificial Sequence
  neuraminidase__InfluenzaA__AEQ49805
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcuaugugaaccaacaauaauagaaagaaacauaacagagauaguguaucugaccaacaccaccauagagaaggaaauaugccccaaaccagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacguaauaggaccccuuaucggacccuauugaugaaugaauuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacauuaucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucgcguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51645 - RNA, 1410 nt, Artificial Sequence
  neuraminidase__InfluenzaA__AEQ49806
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucaugauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuucagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucggguacauauggaacaggcucauggccugauggggcggaccucaaucucaugccuauauaa

SEQ ID NO: 51646 - RNA, 1410 nt, Artificial Sequence
  neuraminidase__InfluenzaA__AEQ49807
augaauccaaaucaaaagauaauaacgauuggcucuguuucucucaccauuuccacaauaugcuucuucaugcaaauugccaucuugauaacuacuguaacacugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcaugucuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaagaucguucauacuagcacauugucaggaagugcucaacaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51647 - RNA, 1410 nt, Artificial Sequence
  neuraminidase__InfluenzaA__AEQ49809
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucaacaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucgaugcuuuuauguggaguugauuaggggaagaaaagaggaaacugaaguuuuguggaccucaaacaguauuguuguguuuuguggcaccucagguacauauggaacaggcucauggccugauggggcggaccucaaucucaugccuauauaa

SEQ ID NO: 51648 - RNA, 1410 nt, Artificial Sequence
  neuraminidase__InfluenzaA__AEQ49811
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucgaugcuuuuauguggaguugauuaggggaagaaaagaggaaacugaaguuuuguggaccucaaacaguauuguuguguuuuguggcaccucagguacauauggaacaggcucauggccugauggggcggaccucaaucucaugccuauauaa

SEQ ID NO: 51649 - RNA, 1410 nt, Artificial Sequence
  neuraminidase__InfluenzaA__AEQ49812
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccucaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaaugacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51650 - RNA, 1410 nt, Artificial Sequence
  neuraminidase__InfluenzaA__AEQ49813
augaauccaaaucaaaagauaauaacgauuggcucuguuucucucaccauuuccacaauaugcuucuucaugcaaauugccaucuugauaacuacuguaacacugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcaugucuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaagaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51651 - RNA, 1410 nt, Artificial Sequence; identical to SEQ ID NO: 51649
  neuraminidase__InfluenzaA__AEQ49815

SEQ ID NO: 51652 - RNA, 1410 nt, Artificial Sequence
  neuraminidase__InfluenzaA__AEQ49816
augaauccaaaccaaaagauaauaacgauuggcucuguuucccucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacaaggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggacgauaaaaaugcaacugcuagcuucaucuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucguugaggaggggaaaaucguucauacuagcacauugucaggaagugcucaacaugucgaggagugcuccugcuauccucgauauccuggugucagaugugucugcagagacaacuggaaaggcuccaauaggcccaucguagauauaaacaugaaggaucauagcauuguuuccaguuauguguguucaggacuuguuggagacacacccagaaaaaacgacagcuccagcaguagccauuguuuugauccuaacgaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaaguauuguggaccucaaacaguauuguuguguuuuguggcaccucagguacauauggaacaggcucauggccugauggggcugacaucaaucucaugccuauauaa

SEQ ID NO: 51653 - RNA, 1410 nt, Artificial Sequence
  neuraminidase__InfluenzaA__AEQ49820
augaauccaaaccaaaagauaauaacgauuggcucuguuucccucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacaaggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggacgauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucaucgaggaggggaaaaucguucauacuagcacauugucaggaagugcucaacaugucgaggagugcuccugcuauccucgauauccuggugucagaugugucugcagagacaacuggaaaggcuccaauaggcccaucguagauauaaacaugaaggaucauagcauuguuuccaguuauguguguucaggacuuguuggagacacacccagaaaaaacgacagcuccagcaguagccauuguuuugauccuaacgaugaagaagguggucauggagugaaaggcugggccuuugaugauggaaaugauguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaaguauuguggaccucaaacaguauuguuguguuuuguggcaccucagguacauauggaacaggcucauggccugauggggcggacaucaaucucaugccuauauaa

SEQ ID NO: 51654 - RNA, 1410 nt, Artificial Sequence; identical to SEQ ID NO: 51653
  neuraminidase__InfluenzaA__AEQ49821

SEQ ID NO: 51655 - RNA, 1410 nt, Artificial Sequence
  neuraminidase__InfluenzaA__AEQ49822
augaauccaaaccaaaagauaauaacgauuggcucuguuucccucaccauuuccacaauaugcuucuucaugcaaauugccaucuugauaaccacuguaacauugcauuucaagcaauaugaauucaacucccccccaaacaaccaagugaugcugugugaaccaacaauaauagaaagaaacauaacagagauaguguaucugaccaacaccaccauagagaaggaaauaugucccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacaaggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggacgauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucaucgaggaggggaaaaucguucauacuagcacauugucaggaagugcucaacaugucgaggagugcuccugcuauccucgauauccuggugucagaugugucugcagagacaacuggaagggcuccaauaggcccaucguagauauaaacaugaaggaucauagcauuguuuccaguuauguguguucaggacuuguuggagacacacccagaaaaaacgacagcuccagcaguagccacuguuuugauccuaacgaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauaaggggaaguaaagaggaaacugaaguauuguggaccucaaacaguauuguuguguuuuguggcaccucagggacauauggaacaggcucauggccugauggggcggacaucaaucucaugccuauauaa

SEQ ID NO: 51656 - RNA, 1410 nt, Artificial Sequence
  neuraminidase__InfluenzaA__AEQ49823
augaauccaaaccaaaagauaauaacgauuggcucuguuucccucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugucccaaacuagcagaauacagaaauuggucaaagccgcaaugugacauuacaggauuugcaccuuuuucuaaggacaacucgauuaggcuuuccgcugguggggacaucugggugacaagagaaccuuaugugucaugcgauccuaacaaguguuaucaauuugcccuuggacaaggaacaacacuaaacaacgugcauucaaauaacacaguacgugauaggaccccuuaucggacccuauugaugaaugaguuagguguuccuuuucaucuggggaccaagcaggugugcauagcaugguccagcucaaguugucacgauggaaaagcauggcugcauguuuguauaacgggggacgauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucaucgaggaggggaaaaucguucauacuagcacauugucaggaagugcucaacaugucgaggagugcuccugcuauccucgauauccuggugucagaugugucugcagagacaacuggaaaggcuccaauaggcccaucguagauauaaacaugaaggaucauagcauuguuuccaguuauguguguucaggacuuguuggagacacacccagaaaaaacgacagcuccagcaguagccauuguuuugauccuaacgaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauaaggggaaguaaagaggaaacugaaguauuguggaccucaaacaguauuguuguguuuuguggcaccucagggacauauggaacaggcucauggccugauggggcggacaucaaucucaugccuauauaa

SEQ ID NO: 51657 - RNA, 1410 nt, Artificial Sequence
  neuraminidase__InfluenzaA__AEQ49824
augaauccaaaccaaaagauaauaacgauuggcucuguuucccucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcggaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacaaggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggacgauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucaucgaggaggggaaaaucguucauacuagcacauugucaggaagugcucaacaugucgaggagugcuccugcuauccucgauauccuggugucagaugugucugcagagacaacuggaaaggcuccaauaggcccaucguagauauaaacaugaaggaucauagcauuguuuccaguuauguguguucaggacuuguuggagacacacccagaaaaaacgacagcuccagcaguagccauuguuuugauccuaacgaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauaaggggaaguaaagaggaaacugaaguauuguggaccucaaacaguauuguuguguuuuguggcaccucagggacauauggaacaggcucauggccugauggggcggacaucaaucucaugccuauauaa

SEQ ID NO: 51658 - RNA, 1410 nt, Artificial Sequence; identical to SEQ ID NO: 51657
  neuraminidase__InfluenzaA__AEQ49825

SEQ ID NO: 51659 - RNA, 1410 nt, Artificial Sequence; identical to SEQ ID NO: 51657
  neuraminidase__InfluenzaA__AEQ49826

SEQ ID NO: 51660 - RNA, 1410 nt, Artificial Sequence; identical to SEQ ID NO: 51657
  neuraminidase__InfluenzaA__AEQ49827

SEQ ID NO: 51661 - RNA, 1410 nt, Artificial Sequence; identical to SEQ ID NO: 51657
  neuraminidase__InfluenzaA__AEQ49828

SEQ ID NO: 51662 - RNA, 1410 nt, Artificial Sequence
  neuraminidase__InfluenzaA__AEQ49829
augaauccaaaccaaaagauaauaacgauuggcucuguuucccucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcggaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcucuuggacaaggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggacgauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuuuaggaaaagcugauacuaaaauacuauucaucgaggaggggaaaaucguucauacuagcacauugucaggaagugcucaacaugucgaggagugcuccugcuauccucgauauccuggugucagaugugucugcagagacaacuggaaaggcuccaauaggcccaucguagauauaaacaugaaggaucauagcauuguuuccaguuauguguguucaggacuuguuggagacacacccagaaaaaacgacagcuccagcaguagccauuguuuugauccuaacgaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauaaggggaaguaaagaggaaacugaaguauuguggaccucaaacaguauuguuguguuuuguggcaccucagggacauauggaacaggcucauggccugauggggcggacaucaaucucaugccuauauaa

SEQ ID NO: 51663 - RNA, 1410 nt, Artificial Sequence
  neuraminidase__InfluenzaA__AEQ49830
augaauccaaaccaaaagauaauaacgauuggcucuguuucccucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcggaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcucuuggacaaggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggacgauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucaucgaggaggggaaaaucguucauacuagcacauugucaggaagugcucaacaugucgaggagugcuccugcuauccucgauauccuggugucagaugugucugcagagacaacuggaaaggcuccaauaggcccaucguagauauaaacaugaaggaucauagcauuguuuccaguuauguguguucaggacuuguuggagacacacccagaaaaaacgacagcuccagcaguagccauuguuuugauccuaacgaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauaaggggaaguaaagaggaaacugaaguauuguggaccucaaacaguauuguuguguuuuguggcaccucagggacauauggaacaggcucauggccugauggggcggacaucaaucucaugccuauauaa

SEQ ID NO: 51664 - RNA, 1410 nt, Artificial Sequence; identical to SEQ ID NO: 51657
  neuraminidase__InfluenzaA__AEQ49831

SEQ ID NO: 51665 - RNA, 1410 nt, Artificial Sequence
  neuraminidase__InfluenzaA__AEQ49832
augaauccaaaccaaaagauaauaacgauuggcucuguuucccucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcggaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacaaggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggacgauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucaucgaggaggggaaaaucguucauacuagcacauugucaggaagugcucaacaugucgaggagugcuccugcuauccucgauauccuggugucagaugugucugcagagacaacuggaaaggcuccaauaggcccaucguagauauaaacaugaaggaucauagcauuguuuccaguuauguguguucaggacuuguuggagacacacccagaaaaaacgacagcuccagcaguagccauuguuuugauccuaacgaugaagaagguggucauggagugaaaggcugggccuuugaugauggaaaugacguguggaugggaagaacgaucagcgagaagucacgcuuaggguaugaaaccuucaaagucguugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauaagggggaguaaagaggaaacugaaguauuguggaccucaaacaguauuguuguguuuuguggcaccucagggacauauggaacaggcucauggccugauggggcggacaucaaucucaugccuauauaa

SEQ ID NO: 51666 - RNA, 1410 nt, Artificial Sequence
  neuraminidase__InfluenzaA__AEQ49833
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaauacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaauccuaaguccaaauugcagauaaguaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51667 - RNA, 1410 nt, Artificial Sequence
  neuraminidase__InfluenzaA__AEQ49835
augaauccaaaccaaaagauaauaacgauuggcucuguuucccucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacaaggaacaacacuaaacaacgugcauucaaauaacacaguacgugauaggaccccuuaucggacccuauugaugaaugaguuagguguuccuuuucaucuggggaccaagcaagugugcauggcaugguccagcucaaguugucacgauggaaaagcauggcugcauguuuguauaacgggggacgauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucaucgaggaggggaaaaucguucauacuagcacauugucaggaagugcucaacaugucgaggaaugcuccugcuauccucgauauccuggugucagaugugucugcagagacaacuggaaaggcuccaauaggcccaucguagauauaaacaugaaggaucauagcauuguuuccaguuauguguguucaggacuuguuggagacacacccagaaaaaacgacagcuccagcaguagccauuguuuugauccuaacgaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaaguauuguggaccucaaacaguauuguuguguuuuguggcaccucagguacauauggaacaggcucauggccugauggggcggacaucaaucucaugccuauauaa

SEQ ID NO: 51668 - RNA, 1410 nt, Artificial Sequence
  neuraminidase__InfluenzaA__AEQ49836
augaauccaaaccaaaagauaauaacgauuggcucuguuucccucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacaaggaacaacacuaaacaacgugcauucaaauaacacaguacgugauaggaccccuuaucggacccuauugaugaaugaguuagguguuccuuuucaucuggggaccaagcaagugugcauggcaugguccagcucaaguugucacgauggaaaagcauggcugcauguuuguauaacgggggacgauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucaucgaggaggggaaaaucguucauacuagcacauugucaggaagugcucaacaugucgaggagugcuccugcuauccucgauauccuggugucagaugugucugcagagacaacuggaaaggcuccaauaggcccaucguagauauaaacaugaaggaucauagcauuguuuccaguuauguguguucaggacuuguuggagacacacccagaaaaaacgacagcuccagcaguagccauuguuuugauccuaacgaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaaguauuguggaccucaaacaguauuguuguguuuuguggcaccucagguacauauggaacaggcucauggccugauggggcggacaucaaucucaugccuauauaa

SEQ ID NO: 51669 - RNA, 1410 nt, Artificial Sequence; identical to SEQ ID NO: 51668
  neuraminidase__InfluenzaA__AEQ49838

SEQ ID NO: 51670 - RNA, 1410 nt, Artificial Sequence; identical to SEQ ID NO: 51667
  neuraminidase__InfluenzaA__AEQ49839

SEQ ID NO: 51671 - RNA, 1410 nt, Artificial Sequence
  neuraminidase__InfluenzaA__AEQ49840
augaauccaaaccaaaagauaauaacgauuggcucuguuucccucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacaaggaacaacacuaaacaacgugcauucaaauaacacaguacgugauaggaccccuuaucggacccuauugaugaaugaguuagguguuccuuuucaucuggggaccaagcaagugugcauggcaugguccagcucaaguugucacgauggaaaagcauggcugcauguuuguauaacgggggacgauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucaucgaggaggggaaaaucguucauacuagcacauugucaggaagugcucaacaugucgaggagugcuccugcuauccucgauauccuggugucagaugugucugcagagacaacuggaaaggcuccaauaggcccaucguagauauaaacaugaaggaucauagcauuguuuccaguuauguguguucaggacuuguuggagacacacccagaaaaaacgacagcuccagcaguagccauuguuuugauccuaacgaugaagaagguggucauggagugaaaggcugggccuuugaugauggaaaugacguguggaugggaagaacgaucagcgagaagucacgcuuaggguaugaaaccuucaaagucauugaaggcugguccaaccauaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaaguauuguggaccucaaacaguauuguuguguuuuguggcaccucagguacauauggaacaggcucauggccugauggggcggacaucaaucucaugccuauauaa

SEQ ID NO: 51672 - RNA, 1410 nt, Artificial Sequence; identical to SEQ ID NO: 51667
  neuraminidase__InfluenzaA__AEQ49841

SEQ ID NO: 51673 - RNA, 1410 nt, Artificial Sequence; identical to SEQ ID NO: 51667
  neuraminidase__InfluenzaA__AEQ49842

SEQ ID NO: 51674 - RNA, 1410 nt, Artificial Sequence; identical to SEQ ID NO: 51667
  neuraminidase__InfluenzaA__AEQ49843

SEQ ID NO: 51675 - RNA, 1410 nt, Artificial Sequence; identical to SEQ ID NO: 51657
  neuraminidase__InfluenzaA__AEQ49844

SEQ ID NO: 51676 - RNA, 1410 nt, Artificial Sequence
  neuraminidase__InfluenzaA__AEQ49845
augaauccaaaccaaaagauaauaacgauuggcucuguuucccucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagagggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacaaggaacaacacuaaacaacgugcauucaaauaacacaguacgugauaggaccccuuaucggacccuauugaugaaugaguuagguguuccuuuucaucuggggaccaagcaagugugcauggcaugguccagcucaaguugucacgauggaaaagcauggcugcauguuuguauaacgggggacgauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucaucgaggaggggaaaaucguucauacuagcacauugucaggaagugcucaacaugucgaggagugcuccugcuauccucgauauccuggugucagaugugucugcagagacaacuggaaaggcuccaauaggcccaucguagauauaaacaugaaggaucauagcauuguuuccaguuauguguguucaggacuuguuggagacacacccagaaaaaacgacagcuccagcaguagccauuguuuugauccuaacgaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaaguauuguggaccucaaacaguauuguuguguuuuguggcaccucagguacauauggaacaggcucauggccugauggggcggacaucaaucucaugccuauauaa

SEQ ID NO: 51677 - RNA, 1410 nt, Artificial Sequence
  neuraminidase__InfluenzaA__AEQ49846
augaauccaaaccaaaagauaauaacgauuggcucuguuucccucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacaaggaacaacacuaaacaacgugcauucaaauaacacaguacgugauaggaccccuuaucggacccuauugaugaaugaguuagguguuccuuuucaucuggggaccaagcaagugugcauggcaugguccagcucaaguugucacgauggaaaagcauggcugcauguuuguauaacgggggacgauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucaucgaggaggggaaaaucguucauacuagcacauugucaggaagugcucaacaugucgaggagugcuccugcuauccucgauauccuggugucagaugugucugcagagacaacuggaaaggcuccaauaggcccaucguagauauaaacuugaaggaucauagcauuguuuccaguuauguguguucaggacuuguuggagacacacccagaaaaaacgacagcuccagcaguagccauuguuuugauccuaacgaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaaguauuguggaccucaaacaguauuguuguguuuuguggcaccucagguacauauggaacaggcucauggccugauggggcggacaucaaucucaugccuauauaa

SEQ ID NO: 51678 - RNA, 1410 nt, Artificial Sequence
  neuraminidase__InfluenzaA__AEQ49850
augaauccaaaccaaaagauaauaacgauuggcucuguuucccucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacaaggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggacgauaaaaaugcaacugcuagcuucauuuacaaugggaggcuuguagauaguguuguuucaugguccaaagaaauccucaggacccaagagucagaaugcguuuguaucaauggaacuuguacaguaguaaugacugaugggagugcuucaggaaaagcugauacuaaaauacuauucaucgaggaggggaaaaucguucauacuagcacauugucaggaagugcucaacaugucgaggagugcuccugcuauccucgauauccuggugucagaugugucugcagagacaacuggaaaggcuccaauaggcccaucguagauauaaacaugaaggaucauagcauuguuuccaguuauguguguucaggacuuguuggagacacacccagaaaaaacgacagcuccagcaguagccauuguuuugauccuaacgaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauaaggggaaguaaagaggaaacugaaguauuguggaccucaaacaguauuguuguguuuuguggcaccucagggacauauggaacaggcucauggccugauggggcggacaucaagaucaugccuauauaa

SEQ ID NO: 51679 - RNA, 1410 nt, Artificial Sequence
  neuraminidase__InfluenzaA__AEQ49851
augaauccaaaucaaaagauaauaacgauuggcucuguuucucucaccauuuccacaauaugcuucuucaugcaaauugccauccugauaacuacuguaacauugcauuucaagcaguaugaauucaacucccccccaaacaaccaagugaugcugugugaaccaacaauaauggaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguugucucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagacauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51680 - RNA, 1410 nt, Artificial Sequence
  neuraminidase__InfluenzaA__AEQ49852
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugauaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguugucucaugguccaaagaaauccucaggacccaggagucagaaugcguuuguaucaaugggacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51681 - RNA, 1410 nt, Artificial Sequence
  neuraminidase__InfluenzaA__AEQ49969
augaauccaaaccaaaagauaauaacgauuggcucuguuucccucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacaaggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggacgauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucaucgaagaggggaaaaucguucauacuagcacacugucaggaagugcucaacaugucgaggagugcuccugcuauccucgauauccuggugucagaugugucugcagagacaacuggaaaggcuccaauaggcccaucguagauauaaacaugaaggaucauagcauuguuuccaguuauguguguucaggacuuguuggagacacacccagaaaaaacgacagcuccagcaguagccauuguuuugauccuaacgaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauaaggggaaguaaagaggaaacugaaguauuguggaccucaaacaguauuguuguguuuuguggcaccucagggacauauggaacaggcucauggccugauggggcggacaucaaucucaugccuauauaa

SEQ ID NO: 51682 - RNA, 1410 nt, Artificial Sequence
  neuraminidase__InfluenzaA__AEQ49970
augaauccaaaucaaaagauaauaacgauuggcucuguuucucucaccauuuccacaauaugcuucuucaugcaaauugccauccugauaacuacuguaacauugcauuucaagcaguaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguugucucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagacauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51683 - RNA, 1410 nt, Artificial Sequence
  neuraminidase__InfluenzaA__AEQ54954
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcgucuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaggaggaaacugaagucuuguggaccucaaacaguauuguuguguuuuguggcaccucagguacauauggaacaggcucauggccugauggggcggaccucaaucucaugccuauauaa

SEQ ID NO: 51684 - RNA, 1410 nt, Artificial Sequence
  neuraminidase__InfluenzaA__AER08645
augaauccaaaucaaaagauaauaacgauuggcucuguuucucucaccauuuccacaauaugcuucuucaugcaaauugccaucuugauaacuacuguaacauugcauuucaagcaauacgaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguuuggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51685 - RNA, 1410 nt, Artificial Sequence
  neuraminidase__InfluenzaA__AER08649
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaacucguucauacaagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51686 - RNA, 1410 nt, Artificial Sequence
  neuraminidase__InfluenzaA__AER08657
augaauccaaaucaaaagauaauaacgauuggcucuguuucucucaccauuuccacaguaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaaugugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51687 - RNA, 1410 nt, Artificial Sequence
  neuraminidase__InfluenzaA__AER08659
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggagcggacaucaaucucaugccuauauaa

SEQ ID NO: 51688 - RNA, 1410 nt, Artificial Sequence
  neuraminidase__InfluenzaA__AER08661
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaaggugaucauggagugaaaggcugggccuuugaugauggaaaugacguguggaugggaagaacgaucaacgagacgucacgcuuaggguaugaaaccuucaaaguaauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51689 - RNA, 1410 nt, Artificial Sequence
  neuraminidase__InfluenzaA__AER08663
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcagugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucaacaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51690 - RNA, 1410 nt, Artificial Sequence
  neuraminidase__InfluenzaA__AER08665
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuaggugugccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacucaggagucagaaugcguuuguaucaauggaacuuguacaguaguaaugacugauggaagugcuucaggcaaagcugauacuaaaauacuauucauugaggaggggaaaaucguucauacuagcacauugucaggaagugcucagcaugucgaggaaugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51691 - RNA, 1410 nt, Artificial Sequence
  neuraminidase__InfluenzaA__AER08669
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcuaugugaaccaacaauaauagaaagaaacauaacagagauaguguaucugaccaacaccaccauagagaaggaaauaugccccacacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51692 - RNA, 1410 nt, Artificial Sequence
  neuraminidase__InfluenzaA__AER08671
augaauccaaaucaaaagauaauaacgauuggcucuguuucucucaccauuuccacaauaugcuucuucaugcaaauugccaucuugauaacuacuguaacauugcauuucaagcaauauggauucaacucccccccaaacaaccaagugaugcuaugugaaccaacaauaauagaaagaaacauaacagagauaguguaucugaccaacaccaccauagagaaggaaauaugccccacacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51693 - RNA, 1410 nt, Artificial Sequence
  neuraminidase__InfluenzaA__AER08673
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaaugugacauuacaggauuugcaccuuuuucuaaggacaauucgauuaggcuuuccgcugguggggacaucugggugacaagagaaccuuaugugucaugugauccugacaaguguuaucaauuugcccuuggacagggaacaacacuaaacaacgugcauucaaauaacacaguacgugauaggaccccuuaucggacccuauugaugaaugaguuaggugugccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggcaaagcugauacuaaaauacuauucauugaggaggggaaaaucguucauacuagcacauugucaggaagugcucagcaugucgaggaaugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51694 - RNA, 1410 nt, Artificial Sequence
  neuraminidase__InfluenzaA__AER08675
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcuaugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacaggggacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucuggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51695 - RNA, 1410 nt, Artificial Sequence
  neuraminidase__InfluenzaA__AER08677
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccuuaaucucaugccuauauaa

SEQ ID NO: 51696 - RNA, 1410 nt, Artificial Sequence
  neuraminidase__InfluenzaA__AER08679
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaagauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51697 - RNA, 1410 nt, Artificial Sequence
  neuraminidase__InfluenzaA__AER08681
augaauccaaaucaaaagauaauaacgauuggcucuguuucucucaccauuuccacaauaugcuucuucaugcaaauugccauauugauaacuacuguaacauugcauuucaagcaauaugaauucaacucccccccaaacaaccaagugaugcugugugaaccgacaauaauagaaagaaacauaacagagauaguguaucugaccaacaccaccauagagaaggaaauaugccccaaacuagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcaagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcccagcaugucgaggagugcucuugcuauccucgauauccuggugucagaugugucugcagagacaacuggaaaggcuccaauaggcccaucguagauauaaacauaaaggaucauagcauaguuuccaguuauguguguucaggacuuguuggagacacacccagaaaaaacgacagcuccagcaguagccauuguuuggauccuaacgaugaagaagguggucauggagugaaaggcugggccuuugaugauggaaaugacguguggaugggaagaacaaucaacgagacgucacgcuugggguaugaaaccuucaaagucauugaaggcugguccaacccuaaguccaaauugcagauaaauaggcaagucauaguugacaaagguaauagguccgguuauucugguauuuucucuguugaaggcaaaagcugcaucaaucggugcuuuuauguggaguugauuaggggaagaaaagaggaaacugaagucuuguggacuucaaacaguauuguuguguuuuguggcaccucagguacauauggaacaggcucauggccugauggggcggaccucaaucucaugccuauauaa

SEQ ID NO: 51698 - RNA, 1410 nt, Artificial Sequence; identical to SEQ ID NO: 51386
  neuraminidase__InfluenzaA__AER08683

SEQ ID NO: 51699 - RNA, 1410 nt, Artificial Sequence
  neuraminidase__InfluenzaA__AER08685
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51700 - RNA, 1410 nt, Artificial Sequence; identical to SEQ ID NO: 51699
  neuraminidase__InfluenzaA__AER08687

SEQ ID NO: 51701 - RNA, 1410 nt, Artificial Sequence
  neuraminidase__InfluenzaA__AER08689
augaauccaaaucaaaagauaauaacgauuggcucuguuucucucaccauuuccacaauaugcuucuucaugcaaauugccauuuugauaacuacuguaacauugcauuucaagcaauaugaauucaacucccccccaaacaaccaagugacgcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuucagcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaagacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51702 - RNA, 1410 nt, Artificial Sequence; identical to SEQ ID NO: 51699
  neuraminidase__InfluenzaA__AER08691

SEQ ID NO: 51703 - RNA, 1410 nt, Artificial Sequence
  neuraminidase__InfluenzaA__AER08693
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaaaaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguugucucaugguccaaagaaauccucaggacccaggagucagaaugcguuuguaucaaugggacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 51704 - RNA, 1410 nt, Artificial Sequence
  neuraminidase__InfluenzaA__AER08697
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcuaugugaaccaacaauaauagaaagaaacauaacagagauaguguaucugaccaacaccaccauagagaaggaaacaugccccacacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgugacgucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaucucaaucucaugccuauauaa

SEQ ID NO: 51705 - RNA, 1410 nt, Artificial Sequence; identical to SEQ ID NO: 51501
  neuraminidase__InfluenzaA__AER92714

SEQ ID NO: 51706 - RNA, 1410 nt, Artificial Sequence
  neuraminidase__InfluenzaA__AER92721
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuuacuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaccgaccgugggugucuuucaaccagaaucuggaauaucagauaggauacauaugcagugggauuuucggagacaauccacguccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguugguuggucuuggccagacggugcugaguugccauuuaccauugacaaguaa

SEQ ID NO: 51707 - RNA, 1410 nt, Artificial Sequence
  neuraminidase__InfluenzaA__AER92724
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuuacuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaccgaccgugggugucuuucaaccagaaucuggaauaucagauaggauacauaugcagugggauuuucggagacaauccacguccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauauuguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguugguuggucuuggccagacggugcugaguugccauuuaccauugacaaguaa

SEQ ID NO: 51708 - RNA, 1413 nt, Artificial Sequence
  neuraminidase__InfluenzaA__AET84165
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucgguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugagugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuauugauggagcaaacggaguaaaaggguuuucauacaaauaugguaaugggguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 51709 - RNA, 1413 nt, Artificial Sequence; identical to SEQ ID NO: 50745
  neuraminidase__InfluenzaA__AET84176

SEQ ID NO: 51710 - RNA, 1413 nt, Artificial Sequence
  neuraminidase__InfluenzaA__AET84187
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucgguugcauggucagcaagcgcaugccaugauggcauggacugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccaaagauggagagggcagcugcaauccagugacuauugauggagcaaacggaguaaaaggguuuucauacaaauaugguaaugggguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 51711 - RNA, 1413 nt, Artificial Sequence
  neuraminidase__InfluenzaA__AET84198
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucaaugacauuggccggcaauucaucucuuuguucuaucaguggaugggcuauauacacgaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucgggauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccaaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccaaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaauuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 51712 - RNA, 1413 nt, Artificial Sequence
  neuraminidase__InfluenzaA__AET84209
augaacccaaaucaaaagauaauaaccauuggaucaaucaguauagcaaucgggauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaaaguuguugcuggagaggacaaaacuucagugacauuggccggcaauucaucucuuuguucuaucaguggaugggcuauaaacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcuuggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuuuaccauaaugaccgauggcccgaguaauaaggccgccucguacaaaauuuucaagaucgaaaaagggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccaaagauggagagggcagcugcaauccagugacuguugauggagcaaacggaguaaaaggguuuucauacaaauaugguaaugggguuuggauaggaaggaccaaaaguaacagacuuagaaagggguuugagaugauuugggauccuaauggauggacaaauaccgacagugauuucucagugaaacaggauguuguagcaauaacugauuggucaggauacagcgggaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 51713 - RNA, 1413 nt, Artificial Sequence
  neuraminidase__InfluenzaA__AET84231
augaacccaaaucaaaagauaauaaccauuggaucaaucaguauagcaaucggaauaauuagucuaauguugcaaauaggaaguauuauuucaauaugggcuagucacucaauccauacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccuccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguagauggagcaaacggagugaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaauugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 51714 - RNA, 1413 nt, Artificial Sequence
  neuraminidase__InfluenzaA__AET84242
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaagucccuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 51715 - RNA, 1413 nt, Artificial Sequence
  neuraminidase__InfluenzaA__AET84253
augaacccaaaucaaaagauaauaaccauuggaucaaucaguauagcaaucggaauaauuagucuaauguugcaaauaggaaguauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguagauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaauugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 51716 - RNA, 1413 nt, Artificial Sequence
  neuraminidase__InfluenzaA__AET84264
augaacccaaaucaaaagauaauaaccauuggaucaaucaguauagcaaucggaauaauuagucuaauguuucaaauaggaaguauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguugauggagcaaacggaguaaaagguuuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 51717 - RNA, 1413 nt, Artificial Sequence
  neuraminidase__InfluenzaA__AET84275
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccaaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 51718 - RNA, 1413 nt, Artificial Sequence
  neuraminidase__InfluenzaA__AET84286
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcacuugggugaaucacacauauguuaauauuaacaacacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauagggagaaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 51719 - RNA, 1413 nt, Artificial Sequence
  neuraminidase__InfluenzaA__AET84297
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguagcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacuacaaacuggucuuggccagacggugcugaguugccguucaccauugacaaguag

SEQ ID NO: 51720 - RNA, 1413 nt, Artificial Sequence
  neuraminidase__InfluenzaA__AET84308
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguagcuguacuaaaauacaacggaauaauaacugaaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacuacaaacuggucuuggccagacggugcugaguugccguucaccauugacaaguag

SEQ ID NO: 51721 - RNA, 1413 nt, Artificial Sequence
  neuraminidase__InfluenzaA__AET84319
augaacccaaaucaaaagauaauaaccauuggaucaaucaguauagcaaucggaauaauuagucuaauguugcaaauaggaaauauuauuucaauaugggcuagucacucaauucaaacuggaagucaaaacaacacuggaauaugcaaccaaagaaucaucacauaugaaaacagcaccugggugaaucacacauauguuaauauuaacaacacuaauguuguugcuggagaggacaaaacuucaaugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaauaggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggauuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcgucaauagugauacugcaaacuggucuuggccagacggugcugaguugccguucaccaucgacaaguag

SEQ ID NO: 51722 - RNA, 1413 nt, Artificial Sequence
  neuraminidase__InfluenzaA__AET84330
augaacccaaaucaaaggauaauaaccauuggaucaaucaguauagcaaucggaauaauuagucuaauguugcaaauaggaaauauuauuucaauaugggcuagucacucaauccaaauuggaagucaaaacaacacuggaauaugcaaccaaagaaucaucacauaugaaaacagcaccugggugaaucauacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccgcaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccaaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 51723 - RNA, 1413 nt, Artificial Sequence
  neuraminidase__InfluenzaA__AET84341
augaacccaaaucaaaggauaauaaccauuggaucaaucaguauagcaaucggaauaauuagucuaauguugcaaauaggaaauauuauuucaauaugggcuagucacucaauccaaauuggaagucaaaacaacacuggaauaugcaaccaaagaaucaucacauaugaaaacagcaccugggugaaucauacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccgcaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccaaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuaaagaaaauacaacaaucuggacuagugggagcagcauuucuuuuuguggcguuaauagugauacugcaaacuggucuuggccagacggugcugaguugccguucaccauugacaaguag

SEQ ID NO: 51724 - RNA, 1413 nt, Artificial Sequence
  neuraminidase__InfluenzaA__AET84363
augaacccaaaucaaaggauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucauacauauguuaauauuaacaacacuaauguuguugcuggagaggacaaaacgucaaugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccgcaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuaccaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccaaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 51725 - RNA, 1413 nt, Artificial Sequence
  neuraminidase__InfluenzaA__AET84374
augaacccaaaucaaaggauaauaaccauuggaucaaucaguauagcaaucggaauaauuagucuaauguugcaaauaggaaauauuauuucaauaugggcuagucacucaauccaaauuggaagucaaaacaacacuggaauaugcaaccaaagaaucaucacauaugaaaacagcaccugggugaaucauacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccgcaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccaaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 51726 - RNA, 1413 nt, Artificial Sequence
  neuraminidase__InfluenzaA__AET84396
augaacccaaaucaaaggauaauaaccauuggaucaaucaguauagcaaucggaauaauuagucuaauguuacaaauaggaaauauuauuucaauaugggcuagucacucaauccaaacuggaagucaaaacaacacuggaauaugcaaccaaagaaucaucacauaugaaaacagcaccugggugaaucauacauauguuaauauuaacaacacuaauguuguugcuggagaggacaaaacgucaaugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccgcaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccaaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 51727 - RNA, 1413 nt, Artificial Sequence
  neuraminidase__InfluenzaA__AET84407
augaacccaaaucaaaggauaauaaccauuggaucaaucaguauagcaaucggaauaauuagucuaauguugcaaauaggaaauauuauuucaauaugggcuagucacucaauccaaauuggaagucaaaacaacacuggaauaugcaaccaaagaaucaucacauaugaaaacagcaccugggugaaucauacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccgcaaaggacagaaguccuuauagggccuuaaugagcuguccucuaggugaagccccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 51728 - RNA, 1413 nt, Artificial Sequence
  neuraminidase__InfluenzaA__AET84418
augaacccaaaucaaaggauaauagccauuggaucaaucaguauagcaaucggaauaauuagucuaauguugcaaauaggaaauauuauuucaauaugggcuagucacucaauccaaauuggaagucaaaacaacacuggaauaugcaaccaaagaaucaucacauaugaaaacagcaccugggugaaucauacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaacgggaccgcaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugauaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 51729 - RNA, 1413 nt, Artificial Sequence
  neuraminidase__InfluenzaA__AET84429
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaguauuaacaacacuaauguuguugcuggaaaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaagacuuggauuaucaaauaggauacaucugcaguggaguguuuggugacaauccccgucccaaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggauuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccauuuaccauugacaaguag

SEQ ID NO: 51730 - RNA, 1413 nt, Artificial Sequence
  neuraminidase__InfluenzaA__AET84440
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccccgucccaaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 51731 - RNA, 1413 nt, Artificial Sequence
  neuraminidase__InfluenzaA__AET84451
augaacccaaaucaaaaaauaauaaccauuggaucaaucaguauagcaaucggaauaauuagucuaauauugcaaauaggaaauauuauuucaauaugggcuagucacucaauccaaacuggaagucaaaaccacacuggaauaugcaaccaaagaaucaucacauaugaaaacagcaccugggugaauaacacauauguuaauauuaacaacaccaauguuguugcugaaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugaccaaaggugcucuauuaaaugacaaacauucaaaugggaccguaacggacagaaguccuuauagggccuuaaugagcuguccucuaggugaagcuccguccccauacaauucaagguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucuguaugaacgggucauguuucaccauaaugaccgauggcccgaguaauggggccgccucguacaaaauuuucaagaucgaaaaggggaagguuaccaaaacaauagaguugaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccgcgucccaaagauggagagggcagcugcaauccagugacuguugauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucaguuaaacaggauguuguagcaauaacugauuggucaggguacagcggaaguuuuguucaacauccugaguuaacaggauuggacuguauaagaccuugcuucuggguugaguuagucagagggcugccuagggaaaauacaacaaucuggacuagugggagcagcauuucuuuuuguggcguuaauagugguacugcaaacuggucuuggccagacggugcugaguugccguucaccauugacaaguag

SEQ ID NO: 51732 - RNA, 1410 nt, Artificial Sequence
  neuraminidase__InfluenzaA__AEV53421
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguucaaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucggccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51733 - RNA, 1410 nt, Artificial Sequence; identical to SEQ ID NO: 50080
  neuraminidase__InfluenzaA__AEV53423

SEQ ID NO: 51734 - RNA, 1410 nt, Artificial Sequence
  neuraminidase__InfluenzaA__AEV53425
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggacaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51735 - RNA, 1410 nt, Artificial Sequence
  neuraminidase__InfluenzaA__AEV53427
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugcguaugcagggauaacuggcauggcucgaaucgaccgugggugucuuucaaccagaaucuggaauaucagauaggauacauaugcaguggaauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuuguggugugaacagugacacuguggguuggucuuggccagacggugcugaguugccauuuaccauugacaaguaa

SEQ ID NO: 51736 - RNA, 1410 nt, Artificial Sequence
  neuraminidase__InfluenzaA__AEV53429
augaauccaaaccaaaagauaauaaccauugguucgguuuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggacaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51737 - RNA, 1410 nt, Artificial Sequence
  neuraminidase__InfluenzaA__AEV53431
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggacaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacaguggcacuguggguuggucuuggccagacggugcugaguugccauuuaccauugacaaauaa

SEQ ID NO: 51738 - RNA, 1410 nt, Artificial Sequence; identical to SEQ ID NO: 48866
  neuraminidase__InfluenzaA__AEV53435

SEQ ID NO: 51739 - RNA, 1410 nt, Artificial Sequence
  neuraminidase__InfluenzaA__AEV53437
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauacauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51740 - RNA, 1410 nt, Artificial Sequence; identical to SEQ ID NO: 47242
  neuraminidase__InfluenzaA__AEV53439

SEQ ID NO: 51741 - RNA, 1410 nt, Artificial Sequence; identical to SEQ ID NO: 48608
  neuraminidase__InfluenzaA__AEV53441

SEQ ID NO: 51742 - RNA, 1410 nt, Artificial Sequence
  neuraminidase__InfluenzaA__AEV53443
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauauaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucggccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51743 - RNA, 1410 nt, Artificial Sequence
  neuraminidase__InfluenzaA__AEV53445
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucggccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagaccauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51744 - RNA, 1410 nt, Artificial Sequence
  neuraminidase__InfluenzaA__AEV53447
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguguguagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51745 - RNA, 1410 nt, Artificial Sequence
  neuraminidase__InfluenzaA__AEV53449
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaaaauagaaaagggaaagauagucaaaucagucgaaaugaaugccccuaauuaucacuaugaggaaugcuccuguuauccugauucuagugaaaucacaugugugugcagggauaacuggcauggcucgaaucggccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51746 - RNA, 1410 nt, Artificial Sequence
  neuraminidase__InfluenzaA__AEV53451
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaaaauagaaaagggaaagauagucaaaucagucgaaaugaaugccccugauuaucacuaugaggaaugcuccuguuauccugauucuagugaaaucacaugugugugcagggauaacuggcauggcucgaaucggccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauauuguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51747 - RNA, 1410 nt, Artificial Sequence; identical to SEQ ID NO: 47242
  neuraminidase__InfluenzaA__AEV53453

SEQ ID NO: 51748 - RNA, 1410 nt, Artificial Sequence
  neuraminidase__InfluenzaA__AEV53455
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugagacagacaauaacuucucaauaaagcaagauaucguaggaauaaaugaguggucaggauauagcgggaguuuuguucagcauccagaacuaacagggcugaauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51749 - RNA, 1410 nt, Artificial Sequence
  neuraminidase__InfluenzaA__AEV53457
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaguagaaaagggaaagauagucaaaucagucgaaaugaaugccccuaauuaucacuaugaggaaugcuccuguuauccugauucuagugaaaucacaugugugugcagggauaacuggcauggcucgaaucggccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauaucuuuuugugguguaaacagugacacuguggguuggucuuggccagacggugcugaguugccauuuaccauugacaaguaa

SEQ ID NO: 51750 - RNA, 1410 nt, Artificial Sequence
  neuraminidase__InfluenzaA__AEV53459
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaauaaccgauggaccaagugauggacaggccucauacaagaucuucagaauagaaaaaggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugagacagacaauaacuucucaauaaagcaagauaucguaggaauaaaugaguggucaggauauagcgggaguuuuguucagcauccagaacuaacagggcugaauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuacuauugacaaguaa

SEQ ID NO: 51751 - RNA, 1410 nt, Artificial Sequence
  neuraminidase__InfluenzaA__AEV53461
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucggccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcggaaguuuuguucagcauccagaacuaacagggcuggauuguauaagaccuugcuucuggguugaacuaaucagagggcgacccaaagagaacacaaucuggacuagcgggagcagcauaucuuuuugugguguaaacagugacacuguggguuggucuuggccagacggugcugaguugccauuuaccauugacaaguaa

SEQ ID NO: 51752 - RNA, 1410 nt, Artificial Sequence
  neuraminidase__InfluenzaA__AEV53463
augaauccaaaccaaaagauaauaaccauugguucggucuguaugacaauuggaauggcuaacuuaauauuacaaauuggaaacauaaucucaauauggauuagccacucaauucaacuugagaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguauaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51753 - RNA, 1410 nt, Artificial Sequence
  neuraminidase__InfluenzaA__AEV53465
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauagacaggccucauacaagaucuucagaauagaaaagggaaaaauagucaaaucagucgaaaugaaugccccuaauuaucacuaugaggaaugcuccuguuauccugauucuagugaaaucacaugugugugcagggauaacuggcauggcucgaaucggccgugggugucuuucaaucagaaucuggaauaucagauaggauacauaugcagugggauuuucggagacaauccacgcccuaaugauaagacaggcaguugugguccaguaucgucuaauggagcaaauggaguaaaaggauuuucauacaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuagauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51754 - RNA, 1410 nt, Artificial Sequence
  neuraminidase__InfluenzaA__AEV53467
augaauccaaaccaaaagauaauaaccauugguucggucuguaugacaauuggaauggcuaacuuaauauuacaaauuggaaacauaaucucaauauggauuagccacucaauucaacuugagaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacggcuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51755 - RNA, 1410 nt, Artificial Sequence; identical to SEQ ID NO: 51754
  neuraminidase__InfluenzaA__AEV53469

SEQ ID NO: 51756 - RNA, 1410 nt, Artificial Sequence; identical to SEQ ID NO: 47242
  neuraminidase__InfluenzaA__AEV53471

SEQ ID NO: 51757 - RNA, 1410 nt, Artificial Sequence; identical to SEQ ID NO: 50812
  neuraminidase__InfluenzaA__AEV53473

SEQ ID NO: 51758 - RNA, 1410 nt, Artificial Sequence; identical to SEQ ID NO: 47242
  neuraminidase__InfluenzaA__AEV53475

SEQ ID NO: 51759 - RNA, 1410 nt, Artificial Sequence; identical to SEQ ID NO: 47242
  neuraminidase__InfluenzaA__AEV53477

SEQ ID NO: 51760 - RNA, 1410 nt, Artificial Sequence; identical to SEQ ID NO: 47242
  neuraminidase__InfluenzaA__AEV53479

SEQ ID NO: 51761 - RNA, 1410 nt, Artificial Sequence
  neuraminidase__InfluenzaA__AEV53481
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauucaucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51762 - RNA, 1410 nt, Artificial Sequence; identical to SEQ ID NO: 47242
  neuraminidase__InfluenzaA__AEV53483

SEQ ID NO: 51763 - RNA, 1410 nt, Artificial Sequence
  neuraminidase__InfluenzaA__AEV53485
augaauccaaaccaaaagauaauaaccauugguucggucuguaugacaauuggaauggcuaacuuaauauuacaaauuggaaacauaaucucaauauggguuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggaccagcgggagcagcauauccuuuugugguguaaacagugacacuguggguuggucuuggccagacggugcugaguugccauuuaccauugacaaguaa

SEQ ID NO: 51764 - RNA, 1410 nt, Artificial Sequence
  neuraminidase__InfluenzaA__AEV53487
augaauccaaaccaaaagauaauaaccauugguucggucuguaugacaauuggaauggcuaacuuaauauuacaaauuggaaacauaaucucaauauggauuagccacucaauucaacuugagaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51765 - RNA, 1410 nt, Artificial Sequence; identical to SEQ ID NO: 48260
  neuraminidase__InfluenzaA__AEV53489

SEQ ID NO: 51766 - RNA, 1410 nt, Artificial Sequence
  neuraminidase__InfluenzaA__AEV53491
augaauccaaaccaaaagauaauaaccauugguuuggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacggcuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51767 - RNA, 1410 nt, Artificial Sequence; identical to SEQ ID NO: 47242
  neuraminidase__InfluenzaA__AEV53493

SEQ ID NO: 51768 - RNA, 1410 nt, Artificial Sequence; identical to SEQ ID NO: 51734
  neuraminidase__InfluenzaA__AEV53495

SEQ ID NO: 51769 - RNA, 1410 nt, Artificial Sequence
  neuraminidase__InfluenzaA__AEV53497
augaauccaaaccaaaagauaauaaccauugguucggucuguaugacaauuggaauggcuaacuuaauauuacaaauuggaaacauaaucucaauauggauuagccacucaauucaacuugagaaucaaaaucagauugaaacaugcaaucaaagcgucauuacuuaugaaaacaacacuuggguaaaucagacauauguuaacaucagcaacaccaacuuugcugcuggacagucagugguuuccgugaacuuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51770 - RNA, 1410 nt, Artificial Sequence; identical to SEQ ID NO: 48260
  neuraminidase__InfluenzaA__AEV53499

SEQ ID NO: 51771 - RNA, 1410 nt, Artificial Sequence
  neuraminidase__InfluenzaA__AEV53501
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51772 - RNA, 1410 nt, Artificial Sequence; identical to SEQ ID NO: 47242
  neuraminidase__InfluenzaA__AEV53503

SEQ ID NO: 51773 - RNA, 1410 nt, Artificial Sequence
  neuraminidase__InfluenzaA__AEV53505
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcaugguucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51774 - RNA, 1410 nt, Artificial Sequence; identical to SEQ ID NO: 49148
  neuraminidase__InfluenzaA__AEV53507

SEQ ID NO: 51775 - RNA, 1410 nt, Artificial Sequence
  neuraminidase__InfluenzaA__AEV53509
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauucuaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauaggaagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51776 - RNA, 1410 nt, Artificial Sequence; identical to SEQ ID NO: 51734
  neuraminidase__InfluenzaA__AEV53511

SEQ ID NO: 51777 - RNA, 1410 nt, Artificial Sequence; identical to SEQ ID NO: 51734
  neuraminidase__InfluenzaA__AEV53513

SEQ ID NO: 51778 - RNA, 1410 nt, Artificial Sequence
  neuraminidase__InfluenzaA__AEV53515
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggacaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagaggacgacccaaagagaacacaaucuggacuagcgggagcagcauauccuuuugugguguaaacagugacacuguggguuggucuuggccagacggugcugaguugccauuuaccauugacaaguaa

SEQ ID NO: 51779 - RNA, 1410 nt, Artificial Sequence
  neuraminidase__InfluenzaA__AEV53517
augaauccaaaccaaaggauaauaaccauugguucgguuuguaugacaauuggaauggcuaacuuaauauuacaaauuggaaacauaaucucaauauggguuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaauuagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51780 - RNA, 1410 nt, Artificial Sequence
  neuraminidase__InfluenzaA__AEV53519
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucuugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucaguugcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccugcuauccugauucuagugaaaucacaugugugugcagggauaacuggcauggcucgaaucgaccgugggugucuuucaaccagaaucuggaguaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugcgguguaaacagugacacuguggguuggucuuggccagacggugcugaguugccauuuaccauugacaaguaa

SEQ ID NO: 51781 - RNA, 1410 nt, Artificial Sequence; identical to SEQ ID NO: 51734
  neuraminidase__InfluenzaA__AEV53521

SEQ ID NO: 51782 - RNA, 1410 nt, Artificial Sequence
  neuraminidase__InfluenzaA__AEV53523
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcggcccaaagagaacacaaucuggacuagcgggagcagcauauccuuuugugguguaaacagugacacuguggguuggucuuggccagacggugcugaguugccauuuaccauugacaaguaa

SEQ ID NO: 51783 - RNA, 1410 nt, Artificial Sequence
  neuraminidase__InfluenzaA__AEV53525
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucuugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucaguugcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuauuacuaugaggaaugcuccugcuauccugauucuagugaaaucacaugugugugcagggauaacuggcauggcucgaaucgaccgugggugucuuucaaccagaaucuggaguaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugcgguguaaacagugacacuguggguuggucuuggccagacggugcugaguugccauuuaccauugacaaguaa

SEQ ID NO: 51784 - RNA, 1410 nt, Artificial Sequence
  neuraminidase__InfluenzaA__AEV53527
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugagaacaacacuuggguaaaucagacauaugucaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuagaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcggaaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51785 - RNA, 1410 nt, Artificial Sequence
  neuraminidase__InfluenzaA__AEV53529
augaauccaaaccaaaagauaauaaccauugguucggucuguaugacaauuggaauggcuaacuuaauauuacaaauuggaaacauaaucucaauauggauuagccacucaauucaacuugagaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaggaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51786 - RNA, 1410 nt, Artificial Sequence; identical to SEQ ID NO: 51734
  neuraminidase__InfluenzaA__AEV53531

SEQ ID NO: 51787 - RNA, 1410 nt, Artificial Sequence
  neuraminidase__InfluenzaA__AEV53533
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuaucggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuauuacuaugaggaaugcuccugcuauccugauucuagugaaaucacaugugugugcagggauaacuggcauggcucgaaucgaccgugggugucuuucaaccagaaucuggaguaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcugaauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51788 - RNA, 1410 nt, Artificial Sequence; identical to SEQ ID NO: 47242
  neuraminidase__InfluenzaA__AEV53535

SEQ ID NO: 51789 - RNA, 1410 nt, Artificial Sequence
  neuraminidase__InfluenzaA__AEV53537
augaauccaaaccaaaagauaauaaccauugguucggucuguaugacaauuggaauggcuaacuuaauauuacaaauuggaaacauaaucucaauauggguuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51790 - RNA, 1410 nt, Artificial Sequence
  neuraminidase__InfluenzaA__AEV53539
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagagauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51791 - RNA, 1410 nt, Artificial Sequence
  neuraminidase__InfluenzaA__AEV53541
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucaaacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugagacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51792 - RNA, 1410 nt, Artificial Sequence
  neuraminidase__InfluenzaA__AEV53543
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucaaacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaaaaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugagacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51793 - RNA, 1410 nt, Artificial Sequence
  neuraminidase__InfluenzaA__AEV53545
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaacuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggauugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51794 - RNA, 1410 nt, Artificial Sequence; identical to SEQ ID NO: 51791
  neuraminidase__InfluenzaA__AEV53547

SEQ ID NO: 51795 - RNA, 1410 nt, Artificial Sequence
  neuraminidase__InfluenzaA__AEV53549
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugagacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51796 - RNA, 1410 nt, Artificial Sequence; identical to SEQ ID NO: 51792
  neuraminidase__InfluenzaA__AEV53551

SEQ ID NO: 51797 - RNA, 1410 nt, Artificial Sequence; identical to SEQ ID NO: 51792
  neuraminidase__InfluenzaA__AEV53553

SEQ ID NO: 51798 - RNA, 1410 nt, Artificial Sequence; identical to SEQ ID NO: 51789
  neuraminidase__InfluenzaA__AEV53555

SEQ ID NO: 51799 - RNA, 1410 nt, Artificial Sequence
  neuraminidase__InfluenzaA__AEV53557
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuaucggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcugaauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51800 - RNA, 1410 nt, Artificial Sequence; identical to SEQ ID NO: 47242
  neuraminidase__InfluenzaA__AEV53559

SEQ ID NO: 51801 - RNA, 1410 nt, Artificial Sequence; identical to SEQ ID NO: 48846
  neuraminidase__InfluenzaA__AEV53561

SEQ ID NO: 51802 - RNA, 1410 nt, Artificial Sequence; identical to SEQ ID NO: 48844
  neuraminidase__InfluenzaA__AEV53563

SEQ ID NO: 51803 - RNA, 1410 nt, Artificial Sequence
  neuraminidase__InfluenzaA__AEV53565
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaauggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaaaggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaaguauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccacuuaccauugacaaguaa

SEQ ID NO: 51804 - RNA, 1410 nt, Artificial Sequence
  neuraminidase__InfluenzaA__AEV53567
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaauggugcuuggauagggagaacuaaaagcauuaguucaagaaacgguuuugagaugauuugggauccgaacggauggacugagacagacaauaacuucucaauaaagcaagauaucguaggaauaaaugaguggucaggauauagcgggaguuuuguucagcauccagaacuaacagggcugaauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51805 - RNA, 1410 nt, Artificial Sequence; identical to SEQ ID NO: 48286
  neuraminidase__InfluenzaA__AEV53569

SEQ ID NO: 51806 - RNA, 1410 nt, Artificial Sequence
  neuraminidase__InfluenzaA__AEV53571
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucaaacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaauggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugagacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcggaagcagcauauccuuuugugguguaaacagugacacuguggguuggucuuggccagacggugcugaguugccauuuaccauugacaaguaa

SEQ ID NO: 51807 - RNA, 1410 nt, Artificial Sequence; identical to SEQ ID NO: 51806
  neuraminidase__InfluenzaA__AEV53573

SEQ ID NO: 51808 - RNA, 1410 nt, Artificial Sequence; identical to SEQ ID NO: 51764
  neuraminidase__InfluenzaA__AEV53575

SEQ ID NO: 51809 - RNA, 1410 nt, Artificial Sequence
  neuraminidase__InfluenzaA__AEV53577
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagauaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcaaccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51810 - RNA, 1410 nt, Artificial Sequence
  neuraminidase__InfluenzaA__AEV53579
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucaaauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugagacagacaauaacuucucaauaaagcaagauaucguaggaauaaaugaguggucaggauauagcgggaguuuuguucagcauccagaacuaacagggcugaauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51811 - RNA, 1410 nt, Artificial Sequence; identical to SEQ ID NO: 51764
  neuraminidase__InfluenzaA__AEV53581

SEQ ID NO: 51812 - RNA, 1410 nt, Artificial Sequence; identical to SEQ ID NO: 51734
  neuraminidase__InfluenzaA__AEV53583

SEQ ID NO: 51813 - RNA, 1410 nt, Artificial Sequence
  neuraminidase__InfluenzaA__AEV53585
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucugggccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggacaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51814 - RNA, 1410 nt, Artificial Sequence
  neuraminidase__InfluenzaA__AEV76877
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaccaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51815 - RNA, 1410 nt, Artificial Sequence; identical to SEQ ID NO: 50795
  neuraminidase__InfluenzaA__AEW10576

SEQ ID NO: 51816 - RNA, 1410 nt, Artificial Sequence; identical to SEQ ID NO: 47242
  neuraminidase__InfluenzaA__AEW10586

SEQ ID NO: 51817 - RNA, 1410 nt, Artificial Sequence; identical to SEQ ID NO: 47306
  neuraminidase__InfluenzaA__AEW10596

SEQ ID NO: 51818 - RNA, 1410 nt, Artificial Sequence
  neuraminidase__InfluenzaA__AEW10606
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggcaucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51819 - RNA, 1410 nt, Artificial Sequence
  neuraminidase__InfluenzaA__AEW10616
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51820 - RNA, 1410 nt, Artificial Sequence
  neuraminidase__InfluenzaA__AEW10626
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguaaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaauggcuguguuaaaguacaacggcauaauaacagacacuaucaagaguuggagaaacaauauauugagaacacaagagucugaaugugcaugugugaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagggggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51821 - RNA, 1410 nt, Artificial Sequence; identical to SEQ ID NO: 47242
  neuraminidase__InfluenzaA__AEW10636

SEQ ID NO: 51822 - RNA, 1410 nt, Artificial Sequence
  neuraminidase__InfluenzaA__AEW10646
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaaaauagucaaaucagucgaaaugaaugccccuaauuaucacuaugaggaauguuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51823 - RNA, 1410 nt, Artificial Sequence; identical to SEQ ID NO: 47562
  neuraminidase__InfluenzaA__AEW10656

SEQ ID NO: 51824 - RNA, 1410 nt, Artificial Sequence; identical to SEQ ID NO: 47562
  neuraminidase__InfluenzaA__AEW10666

SEQ ID NO: 51825 - RNA, 1410 nt, Artificial Sequence; identical to SEQ ID NO: 47242
  neuraminidase__InfluenzaA__AEW10676

SEQ ID NO: 51826 - RNA, 1410 nt, Artificial Sequence; identical to SEQ ID NO: 47242
  neuraminidase__InfluenzaA__AEW10686

SEQ ID NO: 51827 - RNA, 1410 nt, Artificial Sequence; identical to SEQ ID NO: 47242
  neuraminidase__InfluenzaA__AEW10696

SEQ ID NO: 51828 - RNA, 1410 nt, Artificial Sequence; identical to SEQ ID NO: 47562
  neuraminidase__InfluenzaA__AEW10706

SEQ ID NO: 51829 - RNA, 1410 nt, Artificial Sequence; identical to SEQ ID NO: 47241
  neuraminidase__InfluenzaA__AEW10716

SEQ ID NO: 51830 - RNA, 1410 nt, Artificial Sequence; identical to SEQ ID NO: 47562
  neuraminidase__InfluenzaA__AEW10726

SEQ ID NO: 51831 - RNA, 1410 nt, Artificial Sequence; identical to SEQ ID NO: 47242
  neuraminidase__InfluenzaA__AEW10736

SEQ ID NO: 51832 - RNA, 1410 nt, Artificial Sequence; identical to SEQ ID NO: 47241
  neuraminidase__InfluenzaA__AEW10746

SEQ ID NO: 51833 - RNA, 1410 nt, Artificial Sequence; identical to SEQ ID NO: 47241
  neuraminidase__InfluenzaA__AEW10756

SEQ ID NO: 51834 - RNA, 1410 nt, Artificial Sequence; identical to SEQ ID NO: 47241
  neuraminidase__InfluenzaA__AEW10766

SEQ ID NO: 51835 - RNA, 1410 nt, Artificial Sequence; identical to SEQ ID NO: 47241
  neuraminidase__InfluenzaA__AEW10776

SEQ ID NO: 51836 - RNA, 1410 nt, Artificial Sequence; identical to SEQ ID NO: 47241
  neuraminidase__InfluenzaA__AEW10786

SEQ ID NO: 51837 - RNA, 1410 nt, Artificial Sequence; identical to SEQ ID NO: 47241
  neuraminidase__InfluenzaA__AEW10796

SEQ ID NO: 51838 - RNA, 1410 nt, Artificial Sequence; identical to SEQ ID NO: 47241
  neuraminidase__InfluenzaA__AEW10806

SEQ ID NO: 51839 - RNA, 1410 nt, Artificial Sequence; identical to SEQ ID NO: 47232
  neuraminidase__InfluenzaA__AEW10816

SEQ ID NO: 51840 - RNA, 1410 nt, Artificial Sequence; identical to SEQ ID NO: 47242
  neuraminidase__InfluenzaA__AEW10826

SEQ ID NO: 51841 - RNA, 1410 nt, Artificial Sequence
  neuraminidase__InfluenzaA__AEW10836
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaaaauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagugggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51842 - RNA, 1410 nt, Artificial Sequence; identical to SEQ ID NO: 47241
  neuraminidase__InfluenzaA__AEW10846

SEQ ID NO: 51843 - RNA, 1410 nt, Artificial Sequence; identical to SEQ ID NO: 47241
  neuraminidase__InfluenzaA__AEW10856

SEQ ID NO: 51844 - RNA, 1410 nt, Artificial Sequence
  neuraminidase__InfluenzaA__AEW10866
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51845 - RNA, 1410 nt, Artificial Sequence; identical to SEQ ID NO: 47241
  neuraminidase__InfluenzaA__AEW10876

SEQ ID NO: 51846 - RNA, 1410 nt, Artificial Sequence; identical to SEQ ID NO: 47241
  neuraminidase__InfluenzaA__AEW10886

SEQ ID NO: 51847 - RNA, 1410 nt, Artificial Sequence; identical to SEQ ID NO: 47241
  neuraminidase__InfluenzaA__AEW10896

SEQ ID NO: 51848 - RNA, 1410 nt, Artificial Sequence; identical to SEQ ID NO: 47241
  neuraminidase__InfluenzaA__AEW10906

SEQ ID NO: 51849 - RNA, 1410 nt, Artificial Sequence; identical to SEQ ID NO: 47241
  neuraminidase__InfluenzaA__AEW10916

SEQ ID NO: 51850 - RNA, 1410 nt, Artificial Sequence
  neuraminidase__InfluenzaA__AEW10926
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuuaucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51851 - RNA, 1410 nt, Artificial Sequence; identical to SEQ ID NO: 47241
  neuraminidase__InfluenzaA__AEW10936

SEQ ID NO: 51852 - RNA, 1410 nt, Artificial Sequence; identical to SEQ ID NO: 51844
  neuraminidase__InfluenzaA__AEW10946

SEQ ID NO: 51853 - RNA, 1410 nt, Artificial Sequence; identical to SEQ ID NO: 47242
  neuraminidase__InfluenzaA__AEW10956

SEQ ID NO: 51854 - RNA, 1410 nt, Artificial Sequence; identical to SEQ ID NO: 47242
  neuraminidase__InfluenzaA__AEW10966

SEQ ID NO: 51855 - RNA, 1410 nt, Artificial Sequence; identical to SEQ ID NO: 47241
  neuraminidase__InfluenzaA__AEW10976

SEQ ID NO: 51856 - RNA, 1410 nt, Artificial Sequence; identical to SEQ ID NO: 47242
  neuraminidase__InfluenzaA__AEW10986

SEQ ID NO: 51857 - RNA, 1410 nt, Artificial Sequence; identical to SEQ ID NO: 47242
  neuraminidase__InfluenzaA__AEW10996

SEQ ID NO: 51858 - RNA, 1410 nt, Artificial Sequence; identical to SEQ ID NO: 47242
  neuraminidase__InfluenzaA__AEW11006

SEQ ID NO: 51859 - RNA, 1410 nt, Artificial Sequence; identical to SEQ ID NO: 47242
  neuraminidase__InfluenzaA__AEW11016

SEQ ID NO: 51860 - RNA, 1410 nt, Artificial Sequence; identical to SEQ ID NO: 47242
  neuraminidase__InfluenzaA__AEW11026

SEQ ID NO: 51861 - RNA, 1410 nt, Artificial Sequence; identical to SEQ ID NO: 47242
  neuraminidase__InfluenzaA__AEW11036

SEQ ID NO: 51862 - RNA, 1410 nt, Artificial Sequence; identical to SEQ ID NO: 47241
  neuraminidase__InfluenzaA__AEW11046

SEQ ID NO: 51863 - RNA, 1410 nt, Artificial Sequence; identical to SEQ ID NO: 47242
  neuraminidase__InfluenzaA__AEW11056

SEQ ID NO: 51864 - RNA, 1410 nt, Artificial Sequence
  neuraminidase__InfluenzaA__AEW11066
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucguuuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccggaauuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51865 - RNA, 1410 nt, Artificial Sequence; identical to SEQ ID NO: 51864
  neuraminidase__InfluenzaA__AEW11076

SEQ ID NO: 51866 - RNA, 1410 nt, Artificial Sequence; identical to SEQ ID NO: 51864
  neuraminidase__InfluenzaA__AEW11086

SEQ ID NO: 51867 - RNA, 1410 nt, Artificial Sequence; identical to SEQ ID NO: 51864
  neuraminidase__InfluenzaA__AEW11096

SEQ ID NO: 51868 - RNA, 1410 nt, Artificial Sequence; identical to SEQ ID NO: 51864
  neuraminidase__InfluenzaA__AEW11106

SEQ ID NO: 51869 - RNA, 1410 nt, Artificial Sequence; identical to SEQ ID NO: 47686
  neuraminidase__InfluenzaA__AEW11116

SEQ ID NO: 51870 - RNA, 1410 nt, Artificial Sequence; identical to SEQ ID NO: 51864
  neuraminidase__InfluenzaA__AEW11126

SEQ ID NO: 51871 - RNA, 1410 nt, Artificial Sequence; identical to SEQ ID NO: 48139
  neuraminidase__InfluenzaA__AEW11136

SEQ ID NO: 51872 - RNA, 1410 nt, Artificial Sequence; identical to SEQ ID NO: 47242
  neuraminidase__InfluenzaA__AEW11146

SEQ ID NO: 51873 - RNA, 1410 nt, Artificial Sequence; identical to SEQ ID NO: 47242
  neuraminidase__InfluenzaA__AEW11156

SEQ ID NO: 51874 - RNA, 1410 nt, Artificial Sequence; identical to SEQ ID NO: 51864
  neuraminidase__InfluenzaA__AEW11166

SEQ ID NO: 51875 - RNA, 1410 nt, Artificial Sequence; identical to SEQ ID NO: 51864
  neuraminidase__InfluenzaA__AEW11176

SEQ ID NO: 51876 - RNA, 1410 nt, Artificial Sequence
  neuraminidase__InfluenzaA__AEW11186
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauacugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51877 - RNA, 1410 nt, Artificial Sequence; identical to SEQ ID NO: 51864
  neuraminidase__InfluenzaA__AEW11196

SEQ ID NO: 51878 - RNA, 1410 nt, Artificial Sequence; identical to SEQ ID NO: 47242
  neuraminidase__InfluenzaA__AEW11206

SEQ ID NO: 51879 - RNA, 1410 nt, Artificial Sequence; identical to SEQ ID NO: 47242
  neuraminidase__InfluenzaA__AEW11216

SEQ ID NO: 51880 - RNA, 1410 nt, Artificial Sequence; identical to SEQ ID NO: 48139
  neuraminidase__InfluenzaA__AEW11226

SEQ ID NO: 51881 - RNA, 1410 nt, Artificial Sequence; identical to SEQ ID NO: 47242
  neuraminidase__InfluenzaA__AEW11236

SEQ ID NO: 51882 - RNA, 1410 nt, Artificial Sequence; identical to SEQ ID NO: 47242
  neuraminidase__InfluenzaA__AEW11246

SEQ ID NO: 51883 - RNA, 1410 nt, Artificial Sequence; identical to SEQ ID NO: 51864
  neuraminidase__InfluenzaA__AEW11255

SEQ ID NO: 51884 - RNA, 1410 nt, Artificial Sequence; identical to SEQ ID NO: 51864
  neuraminidase__InfluenzaA__AEW11265

SEQ ID NO: 51885 - RNA, 1410 nt, Artificial Sequence; identical to SEQ ID NO: 47242
  neuraminidase__InfluenzaA__AEW11275

SEQ ID NO: 51886 - RNA, 1410 nt, Artificial Sequence
  neuraminidase__InfluenzaA__AEW11285
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagaauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51887 - RNA, 1410 nt, Artificial Sequence; identical to SEQ ID NO: 51864
  neuraminidase__InfluenzaA__AEW11295

SEQ ID NO: 51888 - RNA, 1410 nt, Artificial Sequence; identical to SEQ ID NO: 47242
  neuraminidase__InfluenzaA__AEW11305

SEQ ID NO: 51889 - RNA, 1410 nt, Artificial Sequence; identical to SEQ ID NO: 51864
  neuraminidase__InfluenzaA__AEW11315

SEQ ID NO: 51890 - RNA, 1410 nt, Artificial Sequence; identical to SEQ ID NO: 47242
  neuraminidase__InfluenzaA__AEW11325

SEQ ID NO: 51891 - RNA, 1410 nt, Artificial Sequence; identical to SEQ ID NO: 51771
  neuraminidase__InfluenzaA__AEW25299

SEQ ID NO: 51892 - RNA, 1410 nt, Artificial Sequence; identical to SEQ ID NO: 51771
  neuraminidase__InfluenzaA__AEW25308

SEQ ID NO: 51893 - RNA, 1410 nt, Artificial Sequence
  neuraminidase__InfluenzaA__AEW25317
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggauaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugcgguguaaacagugacacuguggguuggucuuggccagacggugcugaguugccauuuaccauugacaaguaa

SEQ ID NO: 51894 - RNA, 1410 nt, Artificial Sequence
  neuraminidase__InfluenzaA__AEW25324
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcaggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51895 - RNA, 1410 nt, Artificial Sequence
  neuraminidase__InfluenzaA__AEW25327
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccccuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacugugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugcgguguaaacagugacacuguggguuggucuuggccagacggugcugaguugccauuuaccauugacaaguaa

SEQ ID NO: 51896 - RNA, 1410 nt, Artificial Sequence
  neuraminidase__InfluenzaA__AEW25333
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucauacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggguagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagacauugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51897 - RNA, 1410 nt, Artificial Sequence
  neuraminidase__InfluenzaA__AEW25338
augaauccaaaccaaaagauaauaaccauugguucggucuguauggcaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauacgcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugcgguguaaacagugacacuguggguuggucuuggccagacggugcugaguugccauuuaccauugacaaguaa

SEQ ID NO: 51898 - RNA, 1410 nt, Artificial Sequence
  neuraminidase__InfluenzaA__AEW25343
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagaucugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucuguaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaguccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51899 - RNA, 1410 nt, Artificial Sequence
  neuraminidase__InfluenzaA__AEW25351
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucauacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaugacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggacuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51900 - RNA, 1410 nt, Artificial Sequence
  neuraminidase__InfluenzaA__AEW25358
augaauccaaaccaaaagauaauaaccauugguucggucuguaugacaauuggaauggcuaacuuaauauuacaaauuggaaacauaaucucaauauggguuagccacucaauucaacuugggaaucagaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucacaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugucaaguaa

SEQ ID NO: 51901 - RNA, 1410 nt, Artificial Sequence
  neuraminidase__InfluenzaA__AEW25361
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggcccugcuaaaugacaaacauuccaauggaaccauuaaagacaggagcccauaucgaacccuaaugagcuguccuauuggugaaguucccucuccauacaacucaagauuugagucggucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51902 - RNA, 1410 nt, Artificial Sequence
  neuraminidase__InfluenzaA__AEW25379
augaauccaaaccaaaagauaauaaccauugguucggucuguaugacaauuggaauggcuaacuuaauauuacaaauuggaaacauaaucucaauauggacuagccacucaauucaacuugggaaucaaaaccagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaagucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucguccgauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51903 - RNA, 1410 nt, Artificial Sequence
  neuraminidase__InfluenzaA__AEW25387
augaauccaaaccaaaagauaauaaccauugguucggucuguaugacaauuggaauggcuaaccuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguagaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucgaagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51904 - RNA, 1410 nt, Artificial Sequence
  neuraminidase__InfluenzaA__AEW25392
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggaguccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaugauaucguaggaauaaaugaguggucaggauauagcgggaguuuuguucagcauccagaacuaacagggcuggauuguauaagaccuugcuucuggguugaacuaaucagggggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51905 - RNA, 1410 nt, Artificial Sequence
  neuraminidase__InfluenzaA__AEW25397
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagccagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaguccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacaauguggguuggucuuggccagacggugcugaguugccauuuaccauugacaaguaa

SEQ ID NO: 51906 - RNA, 1410 nt, Artificial Sequence
  neuraminidase__InfluenzaA__AEW25402
augaauccaaaccaaaagauaauaaccauugguucggucuguaugacaauuggaauggcuaacuuaauauuacaaauaggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51907 - RNA, 1410 nt, Artificial Sequence
  neuraminidase__InfluenzaA__AEW25407
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacaccaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51908 - RNA, 1410 nt, Artificial Sequence
  neuraminidase__InfluenzaA__AEW25418
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucauacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauaggaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagaaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguugguuuuggccagacggugcugaguugccauuuaccauugacaaguaa

SEQ ID NO: 51909 - RNA, 1410 nt, Artificial Sequence
  neuraminidase__InfluenzaA__AEW25423
augaauccaaaccaaaagauaauaaccauugguucggucuguaugacaauuggaauggcuaacuuaauauuacaaauuggaaacauaaucucaauauggauuagcaacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguugguccuggccagacggugcugaguugccauuuaccauugacaaguaa

SEQ ID NO: 51910 - RNA, 1410 nt, Artificial Sequence
  neuraminidase__InfluenzaA__AEW25426
augaauccaaaccaaaagauaauaaccauugguucggucuguaugacaauuggaauggcuaacuuaauauuacaaauuggaaacauaaucucaauauggauuagccacucaauucaacuugggaaucaaaaccagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaccgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51911 - RNA, 1410 nt, Artificial Sequence
  neuraminidase__InfluenzaA__AEW25432
augaauccaaaccaaaagauaauaaccauugguucggucuguaugacaauuggaauggcuaacuuaauauuacaaauuggaaacauaaucucaauauggacuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugacggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuccucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguauaaacagugacgcuguggguuggucuuggccagacggugcugaguugccauuuaccauugacaaguaa

SEQ ID NO: 51912 - RNA, 1410 nt, Artificial Sequence
  neuraminidase__InfluenzaA__AEW25436
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcaucauuacuuaugaaaacaacacuuggguaaaucagacauauguuaacaucagcaacaccaacuuugcugcuggacagucagugguuuccgugaaacuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucugggccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucggauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaacaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuauggguuggucuuggccagacggugcugaguugccauuuaccauugacaaguaa

SEQ ID NO: 51913 - RNA, 1410 nt, Artificial Sequence; identical to SEQ ID NO: 48776
  neuraminidase__InfluenzaA__AEW25440

SEQ ID NO: 51914 - RNA, 1410 nt, Artificial Sequence
  neuraminidase__InfluenzaA__AEW25448
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugcgguguaaacagugacacuguggguuggucuuggccagacggugcugaguugccauuuaccacugacaaguaa

SEQ ID NO: 51915 - RNA, 1410 nt, Artificial Sequence
  neuraminidase__InfluenzaA__AEW25456
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuuguuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugcccccaauuaucacuaugaggaaugcuccugcuauccugauucuagcgaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugcgguguaaacagugacacuguggguuggucuuggccagacggugcugaguugccauuuaccauugacaaguaa

SEQ ID NO: 51916 - RNA, 1410 nt, Artificial Sequence
  neuraminidase__InfluenzaA__AEW25464
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaacugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugagcugccauuuaccauugacaaguaa

SEQ ID NO: 51917 - RNA, 1410 nt, Artificial Sequence
  neuraminidase__InfluenzaA__AEW25474
augaauccaaaccaaaagauaauaaccauugguucgguuuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaacuuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugcgguguaaacagugacacuguggguuggucuuggccagacggugcugaguugccaucuaccauugacaaguaa

SEQ ID NO: 51918 - RNA, 1410 nt, Artificial Sequence
  neuraminidase__InfluenzaA__AEW25484
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggauaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccacuuggaaugcagaaccuucuucuugacucaaggggccuugcuaaaugacaaacauuccaauggaaccauuaaagacaggagcccguaucgaacccuaaugagcuguccuauuggugaaguucccucuccauacaacucaagauuugagucagucgcuuggucagcaagugcuugucaugauggcaucaauuggcuaacaauuggaauuucuggcccagaccauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugcgguguaaacagugacacuguggguuggucuuggccagacggugcugaguugccauuuaccauugacaaguaa

SEQ ID NO: 51919 - RNA, 1410 nt, Artificial Sequence
  neuraminidase__InfluenzaA__AEW25494
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacucuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggacuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51920 - RNA, 1410 nt, Artificial Sequence
  neuraminidase__InfluenzaA__AEW25503
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggagccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaaugggguaaaaggauuuucauucaaauacggcaauggugcuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51921 - RNA, 1410 nt, Artificial Sequence
  neuraminidase__InfluenzaA__AEW25511
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucauacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaaggggguuguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagauacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucguccaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51922 - RNA, 1410 nt, Artificial Sequence
  neuraminidase__InfluenzaA__AEW25530
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucauacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagauacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagaaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51923 - RNA, 1410 nt, Artificial Sequence
  neuraminidase__InfluenzaA__AEW25537
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaaucaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51924 - RNA, 1410 nt, Artificial Sequence; identical to SEQ ID NO: 51771
  neuraminidase__InfluenzaA__AEW25547

SEQ ID NO: 51925 - RNA, 1410 nt, Artificial Sequence; identical to SEQ ID NO: 51771
  neuraminidase__InfluenzaA__AEW25556

SEQ ID NO: 51926 - RNA, 1410 nt, Artificial Sequence
  neuraminidase__InfluenzaA__AEW25566
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuuguuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51927 - RNA, 1410 nt, Artificial Sequence
  neuraminidase__InfluenzaA__AEW25584
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagguaucguaggaauaaaugaguggucaggauauggcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51928 - RNA, 1410 nt, Artificial Sequence
  neuraminidase__InfluenzaA__AEW25592
augaauccaaaccaaaagauaauaaccauugguucggucuguaugacaauuggaauggcuaaccuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuagcggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugcgguguaaacagugacacuguggguuggucuuggccagacggugcugaguugccauuuaccauugacaaguaa

SEQ ID NO: 51929 - RNA, 1410 nt, Artificial Sequence
  neuraminidase__InfluenzaA__AEW25602
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuucagugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacuggaacagacaaaaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuuguggugugaacagugacacuguggguuggucuuggccagacggugcugaguugccauuuaccauugacaaguaa

SEQ ID NO: 51930 - RNA, 1410 nt, Artificial Sequence
  neuraminidase__InfluenzaA__AEW25612
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauagacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51931 - RNA, 1410 nt, Artificial Sequence
  neuraminidase__InfluenzaA__AEW25622
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacucaaucuggacuagcgggagcagcauauccuuuugugguguaaacagugacacuguggguuggucuuggccagacggugcugaguugccauuuaccauugacaaguaa

SEQ ID NO: 51932 - RNA, 1410 nt, Artificial Sequence
  neuraminidase__InfluenzaA__AEW25631
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaguggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugcgguguaaacagugacacuguggguuggucuuggccagacggugcugaguugccauuuaccauugacaaguaa

SEQ ID NO: 51933 - RNA, 1410 nt, Artificial Sequence
  neuraminidase__InfluenzaA__AEW25639
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaguaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51934 - RNA, 1410 nt, Artificial Sequence
  neuraminidase__InfluenzaA__AEW25648
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucauacauauguuaacaucagcaacaccaacuuugcugcuggacagucagugguuuccgugaaauuggcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagauacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucguccaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51935 - RNA, 1410 nt, Artificial Sequence
  neuraminidase__InfluenzaA__AEW25656
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucccaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51936 - RNA, 1410 nt, Artificial Sequence
  neuraminidase__InfluenzaA__AEW25664
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuuacugcuggacagucagugguuuccgugaaauuagcgggcaauuccucucucugcccuguuaguggaugggcuauauacaguaaagacaacaguauaagaaucgguuccaagggggauguguuugucauaagggagccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaauucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugcgguguaaacagugacacuggggguuggucuuggccagacggugcugaguugccauuuaccauugacaaguaa

SEQ ID NO: 51937 - RNA, 1410 nt, Artificial Sequence; identical to SEQ ID NO: 51931
  neuraminidase__InfluenzaA__AEW25671

SEQ ID NO: 51938 - RNA, 1410 nt, Artificial Sequence
  neuraminidase__InfluenzaA__AEW25680
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugacugauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccaaaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaaauucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacugugggcuggucuuggccagacggugcugaguugccauuuaccauugacaaguaa

SEQ ID NO: 51939 - RNA, 1410 nt, Artificial Sequence
  neuraminidase__InfluenzaA__AEW25689
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagagucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51940 - RNA, 1410 nt, Artificial Sequence
  neuraminidase__InfluenzaA__AEW25698
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucauacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagauacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 51941 - RNA, 1410 nt, Artificial Sequence; identical to SEQ ID NO: 51771
  neuraminidase__InfluenzaA__AEW25708

SEQ ID NO: 51942 - RNA, 1410 nt, Artificial Sequence; identical to SEQ ID NO: 47242
  neuraminidase__InfluenzaA__AEX09177

SEQ ID NO: 51943 - RNA, 1413 nt, Artificial Sequence
  neuraminidase__InfluenzaA__AEX33324
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuacuauuaacaacacuaauguuguugcuggaaaagacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaagcuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaccaaauaggauacaucugcaguggaguguucggugacaauccgcgucccaaagauggagagggcagcuguaauccagugacuguugauggagcagacggaguaaaaggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguuaauagugauacugcaaacuggucuuggccagacggugcugaguugccguucaccauugacaaguag

SEQ ID NO: 51944 - RNA, 1413 nt, Artificial Sequence
  neuraminidase__InfluenzaA__AEX33368
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuugugcuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaaugcuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguuaauagugacacugcaaacuggucuuggccagacggugcugaguugccguucaccauugacaaguag

SEQ ID NO: 51945 - RNA, 1413 nt, Artificial Sequence
  neuraminidase__InfluenzaA__AEX33379
augaauccaaaucaaaaaauaauaaccauuggaucaaucaguauagcaaucggaauaauuagucuaauguugcaaauaggaaauauuauuucaauaugggcuagucacucaauccaaacuggaauucaaaaccacacuggaauaugcaaccaaagaaucaucacauaugaaaacagcaccugggugaaucacacauauguuacuauuaacaacacuaauguuguugcuggaaaagacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucugugugaaugggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccagagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucagcauccugaguuaacaggauuggacuguauaagaccuugcuucuggguugaguuagucagaggacugccuagagaaaauacaacaaucuggacuagugggagcagcauuucuuuuuguggcguuaauagugauacugcaaacuggucuuggccagacggugcugaguugccguucaccauugacaaguag

SEQ ID NO: 51946 - RNA, 1413 nt, Artificial Sequence; identical to SEQ ID NO: 51945
  neuraminidase__InfluenzaA__AEX33390

SEQ ID NO: 51947 - RNA, 1413 nt, Artificial Sequence; identical to SEQ ID NO: 51945
  neuraminidase__InfluenzaA__AEX33401

SEQ ID NO: 51948 - RNA, 1413 nt, Artificial Sequence; identical to SEQ ID NO: 51945
  neuraminidase__InfluenzaA__AEX33412

SEQ ID NO: 51949 - RNA, 1413 nt, Artificial Sequence; identical to SEQ ID NO: 51945
  neuraminidase__InfluenzaA__AEX33423

SEQ ID NO: 51950 - RNA, 1413 nt, Artificial Sequence; identical to SEQ ID NO: 51945
  neuraminidase__InfluenzaA__AEX33434

SEQ ID NO: 51951 - RNA, 1413 nt, Artificial Sequence; identical to SEQ ID NO: 51945
  neuraminidase__InfluenzaA__AEX33445

SEQ ID NO: 51952 - RNA, 1410 nt, Artificial Sequence
  neuraminidase__InfluenzaA__AEX33544
augaauccaaaucaaaagauaauaacaauuggcucuuuuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauaccgaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcaaggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagagaaaacugaagucugguggaccucaaacaguauuguuguguuuuguggcaccucagguacauauggaacaggcucauggccugauggggcggauaucaaucucaugccuauauaa

SEQ ID NO: 51953 - RNA, 1410 nt, Artificial Sequence
  neuraminidase__InfluenzaA__AEX33555
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggaccuuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaaugacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51954 - RNA, 1410 nt, Artificial Sequence
  neuraminidase__InfluenzaA__AEX33610
augaauccaaaucaaaagauaauaacgauuggcucuguuucucucaccauuuccacaauaugcuucuucaugcaaauugccaucuugauaacuacuguaacauugcauuucaagcaauaugaauucaacccccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggaccuuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauaacauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguugcgcucaggauaugaaaccuucaaagucauuggaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51955 - RNA, 1410 nt, Artificial Sequence
  neuraminidase__InfluenzaA__AEX33828
augaauccaaaucaaaagauaauaacgauuggcucuguuucucucacuauuuccacaauaugcuucuucaugcaaauugccaucuugauaacuacuguaacauugcauuucaagcaauaugaauucaacccccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggagaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugaugggaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51956 - RNA, 1410 nt, Artificial Sequence
  neuraminidase__InfluenzaA__AEX33839
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauagucgacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51957 - RNA, 1413 nt, Artificial Sequence
  neuraminidase__InfluenzaA__AEX33861
augaauccaaaucaaaaaauaauaaccauuggaucaaucaguauagcaaucggaacaauuagucuaauguugcaaguaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucaguggcauuggccggcaauucaucucuuuguucuaucaguggaugggcuauauacacaaaagacaacagcauaagaauuggcuccaaaggagauguuuuugucauaagagagccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaauggaauaauaacugaaaccauaaaaaguuggaaaaagcgaauauugagaacacaagagucugaaugugucugugugaacgggucauguuucaccauaaugaccgauggcccgagcaauggggccgccucguauaaaaucuucaagaucgaaaaggggcagguuacuaaaucaguagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 51958 - RNA, 1410 nt, Artificial Sequence
  neuraminidase__InfluenzaA__AEX33872
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcagugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucagggaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuugaauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagauaaauaggcaagucauaguugacagagguaauagauccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51959 - RNA, 1410 nt, Artificial Sequence
  neuraminidase__InfluenzaA__AEX33883
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcagcagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51960 - RNA, 1410 nt, Artificial Sequence
  neuraminidase__InfluenzaA__AEX33894
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucgauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51961 - RNA, 1413 nt, Artificial Sequence
  neuraminidase__InfluenzaA__AEX33916
augaacccaaaucaaaaaauaauaaccauuggaucaaucaguauagcaaucggaauaauuagucuaauauugcaaauaggaaauauuauuucaauaugggcuagucacucaauccaaacuggaagucaaaaccacacuggaauaugcaaccaaagaaucaucacauaugaaaacagcaccugggugaauaacacauauguuaauauuaacaacacuaauguuguugcugaaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguaaaggacagaaguccuuauagggccuuaaugagcuguccucuaggugaagcuccguccccauacaauucaagguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucuguaugaacgggucauguuucaccauaaugaccgauggcccgaguaauggggccgccucguacaaaauuuucaagaucgaaaaggggaagguuaccaaaacaauagaguugaaugcacccaauuuucauuaugaggaauguuccuguuacccagacacuggcacagugauguguguaugcagagacaacuggcaugguucaaaucgaccuugggugucuuuuaaucaaaacuuggauuaucaaacaggauacaucugcaguggaguguucggugacaauccgcgucccaaagauggggagggcagcugcaauccaaugacuguugauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuuuguucaacauccugaguuaacaggauuggacuguauaagaccuugcuucuggguugaguuagucagagggcugccuagggaaaauacaacaaucuggacuagugggagcagcauuuccuuuuguggcguuaauagugguacugcaaacuggucuuggccagacggugcugaguugccguucaccauugacaaguag

SEQ ID NO: 51962 - RNA, 1413 nt, Artificial Sequence
  neuraminidase__InfluenzaA__AEX33927
augaacccaaaucaaaaaauaauaaccauuggaucaaucaguauagcaaucggaauaauuagucuaauauugcaaauaggaaauauuauuucaauaugggcuagucacucaauccaaacugaaagucaaaaccacacuggaauaugcaaccaaagaaucaucacauaugaaaacagcaccugggugaauaacacauauguuaauauuaacaacacuaauguuguugcugaaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguaaaggacagaaguccuuauagggccuuaaugagcuguccucuaggugaagcuccguccccauacaauucaagguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucuguaugaacgggucauguuucaccauaaugaccgauggcccgaguaauggggccgccucguacaaaauuuucaagaucgaaaaggggaagguuaccaaaacaauggaguugaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccgcgucccaaagauggggagggcagcugcaauccagugacuguugauggagcagacggaguaaaaggguuuucauacaaauaugguaaugguguuuggaugggaaggaccaaaaguaacagacuuagaaagggguuugagaugauuugggauccuaauggauggacaaauaccgacagugauuucucagugaaacaggauguuguagcaauaacugauuggucaggguacagcggaaguuuuguucaacauccugaguuaacaggauuggacuguauaagaccuugcuucuggguugaguuagucagagggcuaccuagggaaaauacaacaaucuggacuagugggagcagcauuucuuuuuguggcguuaauagugguacugcaaacuggucuuggccagacggugcugaguugccguucaccauugacaaguag

SEQ ID NO: 51963 - RNA, 1413 nt, Artificial Sequence
  neuraminidase__InfluenzaA__AEX33938
augaacccaaaucaaaaaauaauaaccauuggaucaaucaguauagcaaucggaauaauuagucuaauauugcaaauaggaaauauuauuucaauaugggcuagucacucaauccaaacuggaagucaaaaccacacuggaauaugcaaccaaagaaucaucacauaugaaaacagcaccugggugaauaauacauauguuaauauuaacaacacuaauguuguuguugaaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguaaaggacagaaguccuuauagggccuuaaugagcuguccucuaggugaagcuccguccccauacaauucaagguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucuguaugaacgggucauguuucaccauaaugaccgauggcccgaguaauggggccgccucguacaaaauuuucaagaucgaaaaggggaagguuaccaaaacaauagaguugaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccucgucccaaagauggggagggcagcugcaauccagugacuguugauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuuuguucaacauccugaguuaacaggauuggacuguauaagaccuugcuucuggguugaguuagucagagggcugccuagggaaaauacaacaaucuggacuagugggagcagcauuucuuuuuguggcguuaauagugguacuacaaacuggucuuggccagacggugcugaguugccguucaccauugacaaguag

SEQ ID NO: 51964 - RNA, 1413 nt, Artificial Sequence
  neuraminidase__InfluenzaA__AEX33949
augaacccaaaucaaaaaauaauaaccauuggaucaaucaguauagcaaucggaauaauuagucuaauauugcaaauaggaaauauuauuucaauaugggcuagucacucaauccaaacuggaagucaaaaccacacuggaauaugcaaccaaagaaucaucacauaugaaaacagcaccugggugaauaauacauauguuaauauuaacaacacuaauguuguuguugaaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguaaaggacagaaguccuuauagggccuuaaugagcuguccucuaggugaagcuccguccccauacaauucaagguucgaaucaguugcauggucagcaagcgcaugccaugauggcaugggcugguuaacaaucggaauuucugguccagacaauggagcuguggcuguacuaaaauacaacggaauaauaacugaaaccguaaaaaguuggaaaaagcgaauauuaagaacacaagagucugaaugugucuguaugaacgggucauguuucaccauaaugaccgauggcccgaguaauggggccgccucguacaaaauuuucaagaucgaaaaggggaagguuaccaaaacaauagaguugaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccucgucccaaagauggggagggcagcugcaauccagugacuguugauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuuuguucaacauccugaguuaacaggauuggacuguauaagaccuugcuucuggguugaguuagucagagggcugccuagggaaaauacaacaaucuggacuagugggagcagcauuucuuuuuguggcguuaauagugguacugcaaacuggucuuggccagacggugcugaguugccguucaccauugacaaguag

SEQ ID NO: 51965 - RNA, 1410 nt, Artificial Sequence
  neuraminidase__InfluenzaA__AEX33971
augaauccaaaucaaaagauaauaacgauuggcucuguuucccucaccauuuccacaauaugcuucuucaugcaaauugccaucuugauaacuacuguaacauugcauuucaagcaauaugaauucagcucccccccaaacaaccaagugaugcugugugaaccagcaauaauagaaagaaacauaacagagacaguguaucugaccaacaccaccacagagaaggaaauaugccccaaacuagcagaauacagaaauuggucaaagccgcaaugugacauuacaggauuugcaccuuuuucuaaggacaauucaauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauuguuuccagauaugugugcucaggaauuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaccgaaguuuuguggaccucaaacaguauuguuguguuuuguggcaccucagguacauauggaacaggcucauggccugauggggcggacaucaaucucaugccuauauaa

SEQ ID NO: 51966 - RNA, 1410 nt, Artificial Sequence
  neuraminidase__InfluenzaA__AEX33993
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggagaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuguauaa

SEQ ID NO: 51967 - RNA, 1410 nt, Artificial Sequence
  neuraminidase__InfluenzaA__AEX34026
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagaaaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51968 - RNA, 1410 nt, Artificial Sequence
  neuraminidase__InfluenzaA__AEX34036
augaauccaaaucaaaagauaauaacgauuggcucuguuucucucaccauuuccacaauaugcuucuucaugcaaauugccaucuugauaacuacuguaacauugcauuucaagcaauaugaauucagcucccccccaaacaaccaagugaugcugugugaaccaacaauaauagaaagaaacauaacagagauaguguaucugaccaacaccaccaucgagaaggaaauaugccccaaacuagcagaauacagaaauuggucaaagccgcaaugugacauuacaggauuugcaccuuuuucuaaggacaauucgauuaggcuuuccgcugguggggacaucuggguaacaagagaaccuuaugugucaugcgauccugacaaguguuaucaauuugcccuuggacagggaacaacacuaaacaacgugcauucaaaugacacaguacaugguaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuugugcaguaguaaugacugaugggagugcuucaggaaaagcugauacuaaaauauuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaaacgacagcuccagcaguagccauuguuuggauccuaacaaugaagaagguggucauggagugaaaggcugggccuuugaugauggagaugacguauggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaaguuuuguggaccucaaacaguauuguuguguuuuguggcaccucagguacauauggaacaggcucauggccugauggggcggacaucaaucucaugccuauauaa

SEQ ID NO: 51969 - RNA, 1410 nt, Artificial Sequence
  neuraminidase__InfluenzaA__AEX34058
augaauccaaaucaaaagauaauaacgauuggcucuguuucucucaccauuuccacaauaugcuucuucaugcaaauugccaucuugauaacuacuguaacauugcauuucaagcaauaugaauucagcucccccccaaacaaccaagugaugcugugugaaccagcaauaauagaaagaaacauaacagagauaguguaucugaccaacaccaccauagagaaggaaauaugccccaaacuaacagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaccgaaguuuuguggaccucaaacaguauuguuguguuuuguggcaccucagguacauauggaacaggcucauggccugauggggcggacaucaaucucaugccuauauaa

SEQ ID NO: 51970 - RNA, 1410 nt, Artificial Sequence
  neuraminidase__InfluenzaA__AEX34103
augaauccaaaucaaaagauaauaacgauuggcucuguuucucucaccauuuccacaauaugcuucuucaugcaaauugccaucuugauaacuacuguaacauugcauuucaagcaauaugaauucagcucccccccaaacaaccaagugaugcugugugaaccaacaauaauagaaagaaacauaacagagauaguguaucugaccaacaccaccauagagaaggaaguaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaaaugcucagcaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaccaaaguuuuguggaccucaaacaguauuguuguguuuuguggcaccucagguacauauggaacaggcucauggccugauggggcggacaucaaucucaugccuauauaa

SEQ ID NO: 51971 - RNA, 1410 nt, Artificial Sequence
  neuraminidase__InfluenzaA__AEX34114
augaauccaaaucaaaagauaauaacgauuggcucuguuucucucaccauuuccacaauaugcuucuucaugcaaauugccaucuugauaacuacuguaacauugcauuucaagcaauaugaauucagcucccccccaaacaaccaagugaugcugugugaaccagcaauaauagaaagaaacauaacagagauaguguauccgaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaccgaaguuuuguggaccucaaacaguauuguuguguuuuguggcaccucagguacauauggaacaggcucauggccugauggggcggacaucaaucucaugccuauauaa

SEQ ID NO: 51972 - RNA, 1410 nt, Artificial Sequence
  neuraminidase__InfluenzaA__AEX34137
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugguaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51973 - RNA, 1410 nt, Artificial Sequence
  neuraminidase__InfluenzaA__AEX34191
augaauccaaaucaaaagauaauaacgauuggcucuguuucucucagcauuuccacaauaugcuucuucaugcaaauugccaucuugauaacuacuguaacauugcauuucaagcaauaugaauucaacuccuccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagucugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51974 - RNA, 1410 nt, Artificial Sequence
  neuraminidase__InfluenzaA__AEX34224
augaauccaaaucaaaagauaauaacgauuggcucuguuucucucaccauuuccacaauaugcuucuucaugcaaauugccaucuugauaacuacuguaacauugcauuucaagcaauaugaauucagcucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugguaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaccgaaguuuuguggaccucaaacaguauuguuguguuuuguggcaccucagguacauauggaacaggcucauggccugauggggcggacaucaaucucaugccuauauaa

SEQ ID NO: 51975 - RNA, 1410 nt, Artificial Sequence
  neuraminidase__InfluenzaA__AEX34235
augaauccaaaucaaaagauaauaacgauuggcucuguuucucucaccauuuccacaauaugcuucuucaugcaaauugccaucuugauaacuacuguaacauugcauuucaagcaauaugaauucagcucccccccaaacaaccaagugaugcugugugaaccagcaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaagcgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaccgaaguuuuguggaccucaaacaguauuguuguguuuuguggcaccucagguacauauggaacaggcucauggccugauggggcggacaucaaucucaugccuauauaa

SEQ ID NO: 51976 - RNA, 1410 nt, Artificial Sequence
  neuraminidase__InfluenzaA__AEX34246
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugguaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggaaucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagguaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggagcggacaucaaucucaugccuauauaa

SEQ ID NO: 51977 - RNA, 1410 nt, Artificial Sequence
  neuraminidase__InfluenzaA__AEX34257
augaauccaaaucaaaagauaauaacgauuggcucuguuucucucaccauuuccacaauaugcuucuucaugcaaauugccaucuugauaacuacuguaacauugcauuucaagcaauaugaauucaacuccuccccaaacaaccaagugaugcugugugaaccaacaauaauagaaaggaacauaacagagauaguguaucugaccaacaccaccauagagaaggaaauaugccccaaacuagcagaauacagaaauuggucaaagccgcaaugugacauuacaggauuugcaccuuuuucuaaggacaacucgauuaggcuuuccgcugguggggacaucugggugacaagagaaccuuaugugucaugcgauccugacaaguguuaucaauuugcccuuggacagggaacaacacuaaacaacgugcauucaaauaacacaguacguaauaggaccccuuaucggacccuauugaugaaugaguuagguguuccuuuucaucuggggaccaagcaagucugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaaugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51978 - RNA, 1410 nt, Artificial Sequence
  neuraminidase__InfluenzaA__AEX34268
augaauccaaauaaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacguaauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccuccggacccaggagucagaaugcguuuguaucaauggaacuuguacaguaguaaugacugaugggagugcuucaggaaaagcugauacuaaaauacuauucauugaggaggggaaaaucguucauacuagcaaauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51979 - RNA, 1410 nt, Artificial Sequence
  neuraminidase__InfluenzaA__AEX34278
augaauccaaaucaaaagauaauaacgauuggcucuguuucccucaccauuuccacaauaugcuucuucaugcaaauugccaucuugauaacuacuguaacauugcauuucaagcaauaugaauucagcucccccccaaacaaccaagugaugcugugugaaccagcaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuugggcagggaacaacacuaaacaacgugcauucaaaugacacaguacaugauaggaccccuuaucggacccuauugaugaaugagcuagguguuccauuucaucuggggaccaaacaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaaacgacagcuccagcaguagccauugcuuggauccuaacaaugaaaaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaccgaaguuuuguggaccucaaacaguauuguuguguuuuguggcaccucagguacauauggaacaggcucauggccugauggggcggacaucaaucucaugccuauauaa

SEQ ID NO: 51980 - RNA, 1413 nt, Artificial Sequence
  neuraminidase__InfluenzaA__AEX34310
augaacccaaaucaaaaaauaauaaccauuggaucaaucaguauagcaaucggaauaauuagucuaauguugcaaauaggaaauaucauuucaauaugggcuagucacucaauucaaacuggaacucaaaaccacacuggaauaugcaaccaaagaaucaucacauaugaaaacagcaccugggugaaucacacauauguuaauauuaacaacacuaauguuguugcuggaaaggacaaaacuccagugacauuggucggcaacucaucucuuuguucuaucaguggaugggcuauauacacaaaagacaacagcauaagaauugguucuaaaggagauguuuuugucauaagagaaccuuucauaucauguucucacuuggaaugcaaaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcauaggcugguuaacaaucggaauuucugguccagacaauggagcuguggcuguacuaaaauacaaaggaauaauaacuggaaccauaaaaaguuggaaaaagcaaauauuaagaacacaagagucugaaugugucuguaugaacgggucauguuucaccauaaugaccgaugguccgaguaauggggccgccucguacaaaauuuucaagaucgaaaaggggaagguuacuaaaucaauggaguugaaugcacccaauuuucauuaugaggaauguucuuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauagagagggcagcugcaauccagugacuguugauggagcaaacggaguaaaaggguuuucauacaaauaugguaaugguguuuggauaggaaggaccaaaaguaacagaauuagaaagggguuugagaugauuugggauccuaauggauggacaaauaccgacagugauuucucagugaaacaggauauuguagcaauaacugauuggucaggguacagcggaaguuucguccaacauccugaguuaacaggauuggacuguauaagaccuugcuucuggguugaguuagucagagggcugccuggagaaaauacaacaaucuggacuagugggagcagcauuucuuuuuguggcguuaauggugauauugcaaauuggucuuggccagacggugcugaguugccguucaccauugacaaguag

SEQ ID NO: 51981 - RNA, 1413 nt, Artificial Sequence
  neuraminidase__InfluenzaA__AEX34321
augaacccaaaucaaaagauaauaaccauuggaucaaucaguauagcaaucggaauaauuagucuaauguugcaaauaggaaauauuauuucaauauggguuagucacucaauccaaacuggaagucaaaacaacacuggaauauguaaccaaagaaucaucacauaugaaaacagcaccugggugaaucacacauauguuaauauuaacaacacuaauguuguugcuggagaagacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguagcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 51982 - RNA, 1410 nt, Artificial Sequence
  neuraminidase__InfluenzaA__AEX34356
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauugucucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauaggaccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 51983 - RNA, 1410 nt, Artificial Sequence
  neuraminidase__InfluenzaA__AEX34367
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaauguguuuguaucaauggaacuuguacaguaguaaugacugaugggagugcuucaggaaaagcugauacuaaaauacuauucauugaggaggggaagaucguucauacuagcacauugucaggaagugcuaagcauguugaggagugcuccugcuauccucgacauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggugcggacaucaaucucaugccuauauaa

SEQ ID NO: 51984 - RNA, 1410 nt, Artificial Sequence
  neuraminidase__InfluenzaA__AEX34378
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaccuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaauguguuuguaucaauggaacuuguacaguaguaaugacugaugggagugcuucaggaaaagcugauacuaaaauacuauucauugaggaggggaagaucguucauacuagcacauugucaggaagugcuaagcauguugaggagugcuccugcuauccucgacauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggugcggacaucaaucucaugccuauauaa

SEQ ID NO: 51985 - RNA, 1410 nt, Artificial Sequence
  neuraminidase__InfluenzaA__AEX34400
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugucccaaacuagcagaauacagaaauuggucaaagccgcaaugcgacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaaugacacaguacgugguaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucgggaaaagcugauacuaaaauacuauucauuaaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucgaacaguauuguuguguuuuguggcaccucagguacauauggaacaggcucauggccugauggggcggacaucaaucucaugccuauauaa

SEQ ID NO: 51986 - RNA, 1413 nt, Artificial Sequence
  neuraminidase__InfluenzaA__AEX34432
augaacccaaaucaaaaaauaauaaccauuggaucaaucaguauagcaaucggaauaauuagucuaauauugcaaauaggaaauauuauuucaauaugggcuagucacucaauccaaacuggaagucaaaaccacacuggaauaugcaaccaaagaaucaucacauaugaaaacagcaccugggugaauaauacauauguuaauauuaacaacacuaauguuguuguugaaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguaaaggacagaaguccuuauagggccuuaaugagcuguccucuaggugaagcuccguccccauacaauucaagguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucuguaugaacgggucauguuucaccauaaugaccgauggcccgaguaaugggaccgccucguacaaaauuuucaagaucgaaaaggggaagguuaccaaaacaauagaguugaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccucgucccaaagauggggagggcagcugcaauccagugacuguugauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuuuguucaacauccugaguuaacaggauuggacuguauaagaccuugcuucuggguugaguuagucagagggcugccuagggaaaauacaacaaucuggacuagugggagcagcauuucuuuuuguggcguuaauagugguacugcaaacuggucuuggccagacggugcugaguugccguucaccauugacaaguag

SEQ ID NO: 51987 - RNA, 1413 nt, Artificial Sequence
  neuraminidase__InfluenzaA__AEX34443
augaacccaaaucaaaaaauaauaaccauuggaucaaucaguauagcaaucggaauaauuagucuaauauugcaaauaggaaauauuauuucaauaugggcuagucacucaauccaaacuggaagucaaaaccacacuggaauaugcaaccaaagaaucaucacauaugaaaacagcaccugggugaauaauacauauguuaauauuaacaacacuaauguuguuguugaaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguaaaggacagaaguccuuauagggccuuaaugagcuguccucuaggugaagcuccguccccauacaauucaagguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucuguaugaacgggucauguuucaccauaaugaccgauggcccgaguaaugggaccgccucguacaaaauuuucaagaucgaaaaggggaagguuaccaaaacaauagaguugaaugcacccaauuuucauuaugaggaauguucuuguuacccagacacuggcacagugauguguguaugcagagacaacuggcaugguucaaaucgaccuugggugucuuuuaaucaaaacuuggauuaucaaauaggauacaucugcaguggaguguucggugacaauccucgucccaaagauggggagggcagcugcaauccagugacuguugauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuuuguucaacauccugaguuaacaggauuggacuguauaagaccuugcuucuggguugaguuagucagagggcugccuagggaaaauacaacaaucuggacuagugggagcagcauuucuuuuuguggcguuaauagugguacugcaaacuggucuuggccagacggugcugaguugccguucaccauugacaaguag

SEQ ID NO: 51988 - RNA, 1410 nt, Artificial Sequence; identical to SEQ ID NO: 47107
  neuraminidase__InfluenzaA__AEX34454

SEQ ID NO: 51989 - RNA, 1413 nt, Artificial Sequence
  neuraminidase__InfluenzaA__AEX34465
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcugggaaagacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggagagggcagcuguaauccagugacuguugauggagcagacggaauaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuuuguucaacauccugaguuaacaggauuggacuguaugagaccuugcuucuggguugaguuagucagaggacugccuagagaaaauacaacaaucuggacuagugggagcagcauuucuuuuuguggcguuaauagugauacugcaaacuggucuuggccagacggugcugaguugccguucaccauugacaaguag

SEQ ID NO: 51990 - RNA, 1413 nt, Artificial Sequence
  neuraminidase__InfluenzaA__AEX34476
augaauccaaaucaaaaaauaauaaccauuggaucaaucaguauagcaaucggaauaauuagucuaauguugcaaauaggaaauauuauuucaauaugggcuagucacucaauccaaacuggaagucaaaaucacacuggaauaugcaaccaaagaaucaucacauaugaaaacagcaccugggugaaucacacauauguuacuauuaacaacacuaauguuguugcuggaaaagacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguuaauagugauacugcaaacuggucuuggccagacggugcugaguugccguucaccauugacaaguag

SEQ ID NO: 51991 - RNA, 1413 nt, Artificial Sequence; identical to SEQ ID NO: 51945
  neuraminidase__InfluenzaA__AEX34487

SEQ ID NO: 51992 - RNA, 1413 nt, Artificial Sequence; identical to SEQ ID NO: 51945
  neuraminidase__InfluenzaA__AEX34498

SEQ ID NO: 51993 - RNA, 1413 nt, Artificial Sequence; identical to SEQ ID NO: 51945
  neuraminidase__InfluenzaA__AEX34509

SEQ ID NO: 51994 - RNA, 1413 nt, Artificial Sequence; identical to SEQ ID NO: 51945
  neuraminidase__InfluenzaA__AEX34520

SEQ ID NO: 51995 - RNA, 1413 nt, Artificial Sequence; identical to SEQ ID NO: 51945
  neuraminidase__InfluenzaA__AEX34531

SEQ ID NO: 51996 - RNA, 1413 nt, Artificial Sequence; identical to SEQ ID NO: 51945
  neuraminidase__InfluenzaA__AEX34542

SEQ ID NO: 51997 - RNA, 1413 nt, Artificial Sequence; identical to SEQ ID NO: 51945
  neuraminidase__InfluenzaA__AEX34553

SEQ ID NO: 51998 - RNA, 1413 nt, Artificial Sequence; identical to SEQ ID NO: 51945
  neuraminidase__InfluenzaA__AEX34564

SEQ ID NO: 51999 - RNA, 1413 nt, Artificial Sequence; identical to SEQ ID NO: 51945
  neuraminidase__InfluenzaA__AEX34575

SEQ ID NO: 52000 - RNA, 1413 nt, Artificial Sequence; identical to SEQ ID NO: 51945
  neuraminidase__InfluenzaA__AEX34586

SEQ ID NO: 52001 - RNA, 1413 nt, Artificial Sequence; identical to SEQ ID NO: 51945
  neuraminidase__InfluenzaA__AEX34597

SEQ ID NO: 52002 - RNA, 1413 nt, Artificial Sequence; identical to SEQ ID NO: 51945
  neuraminidase__InfluenzaA__AEX34608

SEQ ID NO: 52003 - RNA, 1413 nt, Artificial Sequence; identical to SEQ ID NO: 51945
  neuraminidase__InfluenzaA__AEX34619

SEQ ID NO: 52004 - RNA, 1413 nt, Artificial Sequence; identical to SEQ ID NO: 51945
  neuraminidase__InfluenzaA__AEX34630

SEQ ID NO: 52005 - RNA, 1413 nt, Artificial Sequence; identical to SEQ ID NO: 51945
  neuraminidase__InfluenzaA__AEX34641

SEQ ID NO: 52006 - RNA, 1413 nt, Artificial Sequence
  neuraminidase__InfluenzaA__AEX34653
augaauccaaaucaaaaaauaauaaccauuggaucaaucaguauagcaaucggaauaauuagucuaauguugcaaguaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucaguggcauuggccggcaauucaucucuuuguucuaucagugggugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggccugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucaugcuucaccauaaugaccgauggcccgaguaauggggccgccucguauaaaaucuucaagaucgaaaaggggcagguuacuaaaucaguagaguuaaaugcacccaauuuucauuaugaggaauguuccuguuacccagacacuggcacagugauguguguaugcagggacaacuggcaugguucaaaucgaccuugggugucuuuuaaucaagacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 52007 - RNA, 1413 nt, Artificial Sequence
  neuraminidase__InfluenzaA__AEX34664
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagugcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaagggaaagguuacuaaaucaagagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacugcugauggagcagacggaguuaagggguuuucauacaaauaugguaaugguguuuggauaggaaggacuaaaaguaacagacuuagaaaggguuuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 52008 - RNA, 1413 nt, Artificial Sequence; identical to SEQ ID NO: 51986
  neuraminidase__InfluenzaA__AEX34686

SEQ ID NO: 52009 - RNA, 1413 nt, Artificial Sequence
  neuraminidase__InfluenzaA__AEX34760
augaacccaaaucaaaaaauaauaaccauuggaucaaucaguauagcaaucggaauaauuagucuaauauugcaaauaggaaauauuauuucaauaugggcuagucacucaauccaaacuggaagucaaaaccacacuggaauaugcaaccaaagaaucaucacauaugaaaacagcaccugggugaauaauacauauguuaauauuaacaacacuaauguuguuguugaaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguaaaggacagaaguccuuauagggccuuaaugagcuguccucuaggugaagcuccguccccauacaauucaagguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucuguaugaacgggucauguuucaccauaaugaccgauggcccgaguaauggggccgccucguacaaaauuuucaagaucgaaaaggggaagguuaccaaaacaauagaguugaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccucgucccaaagauggggagggcagcugcaauccagugacuguugauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuuuguucaacauccugaguuaacaggauuggacuguauaagaccuugcuucuggguugaguuagucagagggcugccuagggaaaauacaacaaucuggacuagugggagcagcauuucuuuuuguggcguuaauagugguacuguaaacuggucuuggccagacggugcugaguugccguucaccauugacaaguag

SEQ ID NO: 52010 - RNA, 1413 nt, Artificial Sequence
  neuraminidase__InfluenzaA__AEX34771
augaacccaaaucaaaaaauaauaaccauuggaucaaucaguauagcaaucggaauaauuagucuaauauugcaaauaggaaauauuauuucaauaugggcuagucacucaauccaaacuggaagucaaaaccacacuggaauaugcaaccaaagaaucaucacauaugaaaacagcaccugggugaauaauacauauguuaauauuaacaacacuaauguuguuguugaaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguaaaggacagaaguccuuauagggccuuaaugagcuguccucuaggugaagcuccguccccauacaauucaagguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucuguaugaacgggucauguuucaccauaaugaccgauggcccgaguaauggggccgccucguacaaaauuuucaagaucgaaaaggggaagguuaccaaaacaauagaguugaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccucgucccaaagauggggagggcagcugcaauccagugacuguugauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuuuguucaacauccugaguuaacaggauuggacuguauaagaccuugcuucuggguugaguuagucagagggcugccuagggaaaauacaacaaucuggacuagugggagcagcauuucuuuuuguggcguuaauagugguacugcaaacuggucuuggccagacggugcugaguugccguucaccauugacaaguag

SEQ ID NO: 52011 - RNA, 1413 nt, Artificial Sequence
  neuraminidase__InfluenzaA__AEX34782
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauauguaaccaaagaaucaucacauaugaaaacagcaccugggugaaucacacauauguuaauauuaacaacacuaauguuguugcuggagaagacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggcugccucguacaaaauuuucaagaucgaaaaggggaagguuacuaaaucaauagaguugaaugcacccaauuuuuauuaugaggaaugcuccuguuacccagacacuggcauagugauguguguaugcagggauaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 52012 - RNA, 1413 nt, Artificial Sequence
  neuraminidase__InfluenzaA__AEX34793
augaacccaaaucaaaaaauaauaaccauuggaucaaucaguauagcaaucggaauaauuagucuaauguugcaaauaggaaauaucauuucaauaugggcuagucacucaauucaaacuggaagucaaaaccacacuggaauaugcaaccaaagaaucaucacauaugaaaacagcaccugggugaaucacacauauguuaauauuaacaacacuaauguuguugcuggaaaggacaaaacuccagugacauuggucggcaacucaucucuuuguucuaucaguggaugggcuauauacacaaaagacaacagcauaagaauuggcucuaaaggagauguuuuugucauaagagaaccuuucauaucauguucucacuuggaaugcaaaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcauaggcugguuaacaaucggaauuucugguccagacaauggagcuguggcuguacuaaaauacaaaggaauaauaacuggaaccauaaaaaguuggaaaaagcaaauauuaagaacacaagagucugaaugugucuguaugaacgggucauguuucaccauaaugaccgaugguccgaguaauggggccgcuucguacaaaauuuucaagaucgaaaaggggaagguuacuaaaucaauggaguugaaugcacccaauuuucauuaugaggaauguucuuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauagagagggcagcugcaauccagugacuguugauggagcaaacggaguaaaaggguuuucauacaaauaugguaaugguguuuggauaggaaggaccaaaaguaacagaauuagaaagggguuugagaugauuugggauccuaauggauggacaaauaccgacagugauuucucagugaaacaggauauuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauggugauauugcaaauuggucuuggccagacggugcugaguugccguucaccauugacaaguag

SEQ ID NO: 52013 - RNA, 1413 nt, Artificial Sequence
  neuraminidase__InfluenzaA__AEX34804
augaacccaaaucaaaaaauaauaaccauuggaucaaucaguauagcaaucggaauaauuagucuaauguugcaaauaggaaauaucauuucaauaugggcuagucacucaauucaaacuggaagucaaaaccacacuggaauaugcaaccaaagaaucaucacauaugaaaacagcaccugggugaaucacacauauguuaauauuaacaacacuaauguuguugcuggaaaggacaaaacuccagugacauuggucggcaacucaucucuuuguucuaucaguggaugggcuauauacacaaaagacaacagcauaagaauuggcucuaaaggagauguuuuugucauaagagaaccuuucauaucauguucucacuuggaaugcaaaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcauaggcugguuaacaaucggaauuucugguccagacaauggagcuguggcuguacuaaaauacaaaggaauaauaacuggaaccauaaaaaguuggaaaaagcaaauauuaagaacacaagagucugaaugugucuguaugaacgggucauguuucaccauaaugaccgaugguccgaguaauggggccgccucguacaaaauuuucaagaucgaaaaggggaagguuacuaaaucaauggaguugaaugcacccaauuuucauuaugaggaauguucuuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauagagagggcagcugcaauccagugacuguugauggagcaaacggaguaaaaggguuuucauacaaauaugguaaugguguuuggauaggaaggaccaaaaguaacagaauuagaaagggguuugagaugauuugggauccuaauggauggacaaauaccgacagugauuucucagugaaacaggauauuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauggugauauugcaaauuggucuuggccagacggugcugaguugccguucaccauugacaaguag

SEQ ID NO: 52014 - RNA, 1413 nt, Artificial Sequence
  neuraminidase__InfluenzaA__AEX34815
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauauguaaccaaagaaucaucacauaugaaaacagcaccugggugaaucacacauauguuaauauuaacaacacuaauguuguugcuggagaagacaaaacuucagugacauugaccggcaauucaucccuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccauccccauacaauucaaaguucgaaucaguugcauggucagcaagcgcaugccaugacggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 52015 - RNA, 1413 nt, Artificial Sequence
  neuraminidase__InfluenzaA__AEX34826
augaacccaaaucaaaaaauaauaaccauuggaucaaucaguauagcaaucggaauaauuagucuaauguugcaaauaggaaauaucauuucaauaugggcuagucacucaauucaaacuggaagucaaaaccacacuggaauaugcaaccaaagaaucaucacauaugaaaacagcaccugggugaaucacacauauguuaauauuaacaacacuaauguuguugcuggaaaggacaaaacuccagugacauuggucggcaacucaucucuuuguucuaucaguggaugggcuauauacacaaaagacaacagcauaagaauuggcucuaaaggagauguuuuugucauaagagaaccuuucauaucauguucucacuuggagugcaaaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcauaggcugguuaacaaucggaauuucugguccagacaauggagcuguggcuguacuaaaauacaaaggaauaauaacuggaaccauaaaaaguuggaaaaagcaaauauuaagaacacaagagucugaaugugucuguaugaacgggucauguuucaccauaaugaccgaugguccgaguaauggggccgccucguacaaaauuuucaagaucgaaaaggggaaaguuacuaaaucaauggaguugaaugcacccaauuuucauuaugaggaauguucuuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauagagagggcagcugcaauccagugacuguugauggagcaaacggaguaaaaggguuuucauacaaauaugguaaugguguuuggauaggaaggaccaaaaguaacagaauuagaaagggguuugagaugauuugggauccuaauggauggacaaauaccgacagugauuucucagugaaacaggauauuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauggugauauugcaaauuggucuuggccagacggugcugaguugccguucaccauugacaaguag

SEQ ID NO: 52016 - RNA, 1413 nt, Artificial Sequence; identical to SEQ ID NO: 52015
  neuraminidase__InfluenzaA__AEX34837

SEQ ID NO: 52017 - RNA, 1413 nt, Artificial Sequence
  neuraminidase__InfluenzaA__AEX34859
augaacccaaaucaaaaaauaauaaccauuggaucaaccaguauagcaaucggaauaauuagucuaauguugcaaauaggaaauaucauuucaauaugggcuagucacucaauucaaacuggaagucaaaaccacacuggaauaugcaaccaaagaaucaucacauaugaaaacagcaccugggugaaucacacauauguuaauauuaacaacacuaauguuguugcuggaaaggacaaaacuccagugacauugaucggcaacucaucucuuuguucuaucaguggaugggcuauauacacaaaagacaacagcauaagaauuggcucuaaaggagauguuuuugucauaagagaaccuuucauaucauguucucacuuggaaugcaaaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcauaggcugguuaacaaucggaauuucugguccagacaauggagcuguggcuguacuaaaauacaaaggaauaauaacuggaaccauaaaaaguuggaaaaagcaaauauuaagaacacaagagucugaaugugucuguaugaacgggucauguuucaccauaaugaccgaugguccgaguaauggggccgccucguacaaaauuuucaagaucgaaaaggggaagguuacuaaaucaauggaguugaaugcacccaauuuucauuaugaggaauguucuuguuacccagacacuggcacagugauguguguaugcagggacaacuggcaugguucaaaucgaccuugggugucuuuuaaucaaaacuuggauuaucaaauaggauacaucugcaguggaguguucggugacaacccgcgucccaaagauagagagggcagcugcaauccagugacuguugauggagcaaacggaguaaaaggguuuucauacaaauaugguaaugguguuuggauaggaaggaccaaaaguaacagaauuagaaagggguuugagaugauuugggauccuaauggauggacaaauaccgacagugauuucucagugaaacaggauauuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauggugauauugcaaauuggucuuggccagacggugcugaguugccguucaccauugacaaguag

SEQ ID NO: 52018 - RNA, 1413 nt, Artificial Sequence
  neuraminidase__InfluenzaA__AEX34870
augaacccaaaucaaaagauaauaaccauuggaucaaucaguauagcaaucggaauaaucagucuaauguugcaaauaggaaacauuauuucaauaugggcuagucacucaauccaaacuggaagucaaaacaacacuggaauauguaaccaaagaaucaucacauaugaaaacaguaccugggugaaucacacauauguuaauauuaacaacacuaauguuguugcuggagaagacaaaauuucagugacauuggccggcaauucgucucuuuguuccaucaguggaugggccauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcauaggcuggcuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaaaguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcguccagaagauggagagggcagcugcaauccagugacuguugauggagcaaacggaguaaaaggguuuucauacaaauaugguaaugguguuuggauaggaagaaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 52019 - RNA, 1413 nt, Artificial Sequence
  neuraminidase__InfluenzaA__AEX34881
augaacccaaaucaaaaaauaauaaccauuggaucaaucaguauagcaaucggaauaauuagucuaauguugcaaauaggaaauaucauuucaauaugggcuagucacucaauucaaacuggaagucaaaaccacacuggaauaugcaaccaaagaaucaucacauaugaaaacagcaccugggugaaucacacauauguuaauauuaacaacacuaauguuguugcuggaaaggacaaagcuccagugacauugaucggcaacucaucucuuuguucuaucaguggaugggcuauauacacaaaagacaacagcauaagaauuggcucuaaaggagauguuuuugucauaagagaaccuuucauaucauguucucacuuggaaugcaaaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcauaggcugguuaacaaucggaauuucugguccagacaauggagcuguggcuguacuaaaauacaaaggaauaauaacuggaaccauaaaaaguuggaaaaagcaaauauuaagaacacaagagucugaaugugucuguaugaacgggucauguuucaccauaaugaccgaugguccgaguaauggggccgccucguacaaaauuuucaagaucgaaaaggggaagguuacuaaaucaauggaguugaaugcacccaauuuucauuaugaggaauguucuuguuacccagacacuggcacagugauguguguaugcagggacaacuggcaugguucaaaucgaccuugggugucuuuuaaucaaaacuuggauuaucaaauaggauacaucugcaguggaguguucggugacaacccgcgucccaaagauagagagggcagcugcaauccagugacuguugauggagcaaacggaguaaaaggguuuucauacaaauaugguaaugguguuuggauaggaaggaccaaaaguaacagaauuagaaagggguuugagaugauuugggauccuaauggauggacaaauaccgacagugauuucucagugaaacaggauauuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauggugauauugcaaauuggucuuggccagacggugcugaguugccguucaccauugacaaguag

SEQ ID NO: 52020 - RNA, 1413 nt, Artificial Sequence
  neuraminidase__InfluenzaA__AEX34892
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaagacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcauggcucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacagaauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 52021 - RNA, 1413 nt, Artificial Sequence
  neuraminidase__InfluenzaA__AEX34903
augaacccaaaucaaaaaauaauaaccauuggaucaaucaguauagcaaucggaauaauuagucuaauguugcaaauaggaaauaucauuucaauaugggcuagucgcucaauucaaacuggaagucaaaaccacacuggaauaugcaaccaaagaaucaucacauaugaaaacagcaccugggugaaucacacauauguuaauauuaacaacacuaauguuguugcuggaaaggacaaaacuccagugacauuggucggcaacucaucucuuuguucuaucaguggaugggcuauauacacaaaagacaacagcauaagaauuggcucuaaaggagauguuuuugucauaagagaaccuuucauaucauguucucacuuggaaugcaaaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcauaggcugguuaacaaucggaauuucugguccagacaauggagcuguggcuguacuaaaauacaaaggaauaauaacuggaaccauaaaaaguuggaaaaagcaaauauuaagaacacaagagucugaaugugucuguaugaacgggucauguuucaccauaaugaccgaugguccgaguaauggggccgccucguacaaaauuuucaagaucgaaaaggggaagguuacuaaaucaauggaguugaaugcacccaauuuucauuaugaggaauguucuuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauagagagggcagcugcaauccagugacuguugauggagcaaacggaguaaaaggguuuucauacaaauaugguaaugguguuuggauaggaaggaccaaaaguaacagaauuagaaagggguuugagaugauuugggauccuaauggauggacaaauaccgacagugauuucucagugagacaggauauuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauggugauauugcaaauuggucuuggccagacggugcugaguugccguucaccauugacaaguag

SEQ ID NO: 52022 - RNA, 1413 nt, Artificial Sequence
  neuraminidase__InfluenzaA__AEX34914
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacucaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuuccuuuuguggcguuaauagugauacugcaaacuggucuuggccagacggugcugaguugccguucaccauugacaaguag

SEQ ID NO: 52023 - RNA, 1413 nt, Artificial Sequence
  neuraminidase__InfluenzaA__AEX34925
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauauguaaccaaagaaucaucacauaugaaaacagcaccugggugaaucacacauauguuaauauuaacaacacuaauguuguugcuggagaagacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 52024 - RNA, 1413 nt, Artificial Sequence
  neuraminidase__InfluenzaA__AEX34936
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauauguaaccaaagaaucaucacauaugaaaacagcaccugggugaaucacacauauguuaauauuaacaacacuaauguuguugcuggagaagacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguagcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 52025 - RNA, 1413 nt, Artificial Sequence; identical to SEQ ID NO: 52024
  neuraminidase__InfluenzaA__AEX34947

SEQ ID NO: 52026 - RNA, 1413 nt, Artificial Sequence; identical to SEQ ID NO: 52024
  neuraminidase__InfluenzaA__AEX34958

SEQ ID NO: 52027 - RNA, 1413 nt, Artificial Sequence; identical to SEQ ID NO: 52024
  neuraminidase__InfluenzaA__AEX34969

SEQ ID NO: 52028 - RNA, 1413 nt, Artificial Sequence; identical to SEQ ID NO: 52024
  neuraminidase__InfluenzaA__AEX34980

SEQ ID NO: 52029 - RNA, 1413 nt, Artificial Sequence; identical to SEQ ID NO: 52024
  neuraminidase__InfluenzaA__AEX34991

SEQ ID NO: 52030 - RNA, 1413 nt, Artificial Sequence
  neuraminidase__InfluenzaA__AEX35002
augaacccaaaucaaaaaauaauaaccauuggaucaaucaguauagcaaucggaauaauuagucuaauguugcaaauaggaaauaucauuucaauaugggcuagucacucaauucaaacuggaagucaaaaccacacuggaauaugcaaccaaagaaucaucacauaugaaaacagcaccugggugaaucacacauauguuaauauuaacaacacuaauguuguugcuggaaaggacaaaacuccagugacauugaucggcaacucaucucuuuguucuaucaguggaugggcuauauacacaaaagacaacagcauaagaauuggcucuaaaggagauguuuuugucauaagagaaccuuucauaucauguucucacuuggaaugcaaaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcauaggcugguuaacaaucggaauuucugguccagacaauggagcuguggcuguacuaaaauacaaaggaauaauaacuggaaccauaaaaaguuggaaaaagcaaauauuaagaacacaagagucugaaugugucuguaugaacgggucauguuucaccauaaugaccgaugguccgaguaauggggccgccucguacaaaauuuucaagaucgaaaaggggaagguuacuaaaucaauggaguugaaugcacccaauuuucauuaugaggaauguucuuguuacccagacacuggcacagugauguguguaugcagggacaacuggcaugguucaaaucgaccuugggugucuuuuaaucaaaacuuggauuaucaaauaggauacaucugcaguggaguguucggugacaacccgcgucccaaagauagagagggcagcugcaauccagugacuguugauggagcaaacggaguaaaaggguuuucauacaaauaugguaaugguguuuggauaggaaggaccaaaaguaacagaauuagaaagggguuugagaugauuugggauccuaauggauggacaaauaccgacagugauuucucagugaaacaggauauuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauggugauauugcaaauuggucuuggccagacggugcugaguugccguucaccauugacaaguag

SEQ ID NO: 52031 - RNA, 1413 nt, Artificial Sequence; identical to SEQ ID NO: 52024
  neuraminidase__InfluenzaA__AEX35013

SEQ ID NO: 52032 - RNA, 1413 nt, Artificial Sequence
  neuraminidase__InfluenzaA__AEX35024
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauauguaaccaaagaaucaucacauaugaaaacagcaccugggugaaucacacauauguuaauauuaacaacacuaauguuguugcuggagaagacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguagcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugagcugccguucaccauugacaaguag

SEQ ID NO: 52033 - RNA, 1413 nt, Artificial Sequence; identical to SEQ ID NO: 52024
  neuraminidase__InfluenzaA__AEX35035

SEQ ID NO: 52034 - RNA, 1413 nt, Artificial Sequence; identical to SEQ ID NO: 52024
  neuraminidase__InfluenzaA__AEX35046

SEQ ID NO: 52035 - RNA, 1413 nt, Artificial Sequence; identical to SEQ ID NO: 52032
  neuraminidase__InfluenzaA__AEX35057

SEQ ID NO: 52036 - RNA, 1413 nt, Artificial Sequence; identical to SEQ ID NO: 52024
  neuraminidase__InfluenzaA__AEX35068

SEQ ID NO: 52037 - RNA, 1413 nt, Artificial Sequence
  neuraminidase__InfluenzaA__AEX35079
augaacccaaaucaaaagauaauaaccauuggaucaaucaguauagcaaucggaauaauuagucuaauguugcaaauaggaaauauuauuucaaugugggcuagucacucaauccaaacuggaagucaaaacaacacuggaauauguaaccaaagaaucaucacauaugaaaacagcaccugggugaaucacacauauguuaauauuaacaacacuaauguuguugcuggagaagacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaagacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 52038 - RNA, 1413 nt, Artificial Sequence; identical to SEQ ID NO: 52013
  neuraminidase__InfluenzaA__AEX35090

SEQ ID NO: 52039 - RNA, 1413 nt, Artificial Sequence
  neuraminidase__InfluenzaA__AEX35101
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaauggaaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacaguguuuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 52040 - RNA, 1413 nt, Artificial Sequence
  neuraminidase__InfluenzaA__AEX35112
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauauguaaccaaagaaucaucacauaugaaaacagcaccugggugaaucacacauauguuaauauuaacaacacuaauguuguugcuggagaagacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcauccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 52041 - RNA, 1413 nt, Artificial Sequence
  neuraminidase__InfluenzaA__AEX35123
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauauguaaccaaagaaucaucacauaugaaaacagcaccugggugaaucacacauauguuaauauuaacaacacuaauguuguugcuggagaagacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggcugccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 52042 - RNA, 1413 nt, Artificial Sequence
  neuraminidase__InfluenzaA__AEX35145
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauauguaaccaaagaaucaucacauaugaaaacagcaccugggugaaucacacauauguuaauauuaacaacacuaauguuguugcuggagaagacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggcugccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguucggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauauuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 52043 - RNA, 1413 nt, Artificial Sequence; identical to SEQ ID NO: 52013
  neuraminidase__InfluenzaA__AEX35156

SEQ ID NO: 52044 - RNA, 1413 nt, Artificial Sequence
  neuraminidase__InfluenzaA__AEX35167
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauauguaaccaaagaaucaucacauaugaaaacagcaccugggugaaucacacauauguuaauauuaacaacacuaauguuguugcuggagaagacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccauccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 52045 - RNA, 1413 nt, Artificial Sequence
  neuraminidase__InfluenzaA__AEX35178
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagugcaugccaugauggcaugggcugguuaacaaucggaauuucugguccagacaauggagcuguggcuguacuaaaauacaacggaauaauaacugaaaccauaaaaaguuggaaagagcgaauauugagaacacaagagucugaaugugucugugugaacgggucauguuucaccauaaugaccgauggcccgaguaauggggccgccucguacaaaaucuucaagaucgaaaagggaaagguuacuaaaucaagagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggguacaucugcaguggaguguucggugacaauccgcgucccaaagauggaaagggcagcuguaauccagugacugcugauggagcagacggaguuaagggguuuucauacaaauaugguaaugguguuuggauaggaaggacuaaaaguaacagacuuagaaaggguuuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 52046 - RNA, 1413 nt, Artificial Sequence; identical to SEQ ID NO: 51986
  neuraminidase__InfluenzaA__AEX35189

SEQ ID NO: 52047 - RNA, 1413 nt, Artificial Sequence; identical to SEQ ID NO: 51986
  neuraminidase__InfluenzaA__AEX35200

SEQ ID NO: 52048 - RNA, 1413 nt, Artificial Sequence
  neuraminidase__InfluenzaA__AEX35211
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauauguaaccaaagaaucaucacauaugaaaacagcaccugggugaaucacacauauguuaauauuaacaacacuaauguuguugcuggagaagacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagaaucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 52049 - RNA, 1410 nt, Artificial Sequence
  neuraminidase__InfluenzaA__AEX35222
augaauccaaaucaaaagauaauaacgauuggcucuguuucucucaccauuuccacaauaugcuucuuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugucccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaauguuaucaauuugcccuuggacagggaacaacacuaaacaacgggcauucaaaugacacaguacaugauaggaccccuuaucggacccuauugaugaaugaguuggguguuccauuucaucuggggaccaagcaagugugcauagcaugguccagcucaaguugucaugauggaaaagcauggcugcauguuuguguaacgggggaugaugaaaaugcaacugcuagcuucauuuacaaugggaggcuuguagauaguauugguucaugguccaaaaaaauccucaggacccaggagucagaaugcguuuguaucaauggaacuuguacaguaguaaugacugaugggagugcuucaggaaaagccgauacuaaaauacuauucauugaggaggggaaaaucguucauaccagcacauugucaggaagugcucagcaugucgaggagugcuccuguuauccucgauauccuggugucagaugugucugcagagacaacuggaaaggcuccaauaggcccaucguagauauaaauauaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacaaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaauugauaaggggaaggaaacaggaaacugaagucuuguggaccucaaacaguauuguuguguuuuguggcacuucagguacauauggaacaggcucauggccugauggggcggacaucaaucucaugccuauauaa

SEQ ID NO: 52050 - RNA, 1413 nt, Artificial Sequence; identical to SEQ ID NO: 51945
  neuraminidase__InfluenzaA__AEX35233

SEQ ID NO: 52051 - RNA, 1410 nt, Artificial Sequence
  neuraminidase__InfluenzaA__AEX35244
augaauccaaaucaaaagauaauaacgauuggcucuguuucucucaccauuuccacaauaugcuucuucaugcaaauugccauccugauaaauacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcucuuggacagggaacaacacuaaacaacgugcauucaaaugacacaguacaugauaggaccccuuaucggacccuauugaugaaugaguuggguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccuguuauccucgauauccuggugucagaugugucugcagggacaauuggaaaggcuccaauaggcccaucguagauauaaacauaaaggauuauagcauuguuuccaguuaugugugcucaggacuuguuggagacacacccagaaaaaacgacagcuccagcaguagccauugcuuggauccaaacaaugaggaaggugguaauggagugaaaggcugggccuuugaugauggaaaugacguauggaugggaagaacgaucagcgagaaguuacgcucaggguaugaaaccuucaaagucauugaaggcugguccaacccuaacuccaaauugcagauaaauagacaagucauaguugacagagguaauagguccgguuauucugguauuuucucuguugaaggcaaaagcugcaucaaucggugcuuuuauguggaguugauaagaggaagaaaacaggaaaaugaagucuuguggaccucaaacaguauuguuguguuuuguggcaccucagguacauauggaacaggcucauggccugauggggcggacaucaaucucaugccuguauaa

SEQ ID NO: 52052 - RNA, 1410 nt, Artificial Sequence
  neuraminidase__InfluenzaA__AEX35255
augaauccaaaucaaaagauaauaacgauuggcucuguuucucucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcuggcggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuccaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaagggaaaaucguucauacuagcacauugucaggaagugcucagcaugucgaggagugcuccuguuauccucgauauccuggugucagaugugucugcagagacaauuggaaaggcuccaauaggcccaucguagauauaaacauaaaggauuauagcauuguuuccaguuaugugugcucaggacuuguuggagacacacccagaaaaaacgacagcuccagcaguagccauugcuuggauccaaacaaugaggaagguggucauggagugaaaggcugggccuuugaugauggaaaugacguguggaugggaagaacgaucagcgagaaguuacgcucaggauaugaaaccuucaaagucauugaaggcugguccaacccuaacuccaaauugcagauaaauaggcaagucauaguugacagggguaauagguccgguuauucugguauuuucucuguugaaggcaaaagcugcaucaaucggugcuuuuauguggaguugauaagaggaagaaaacaggaaacugaagucuuguggaccucaaacaguauuguuguguuuuguggcaccucagguacauauggaacaggcucauggccugauggggcggacaucaaucucaugccuauauaa

SEQ ID NO: 52053 - RNA, 1413 nt, Artificial Sequence; identical to SEQ ID NO: 51945
  neuraminidase__InfluenzaA__AEX35266

SEQ ID NO: 52054 - RNA, 1413 nt, Artificial Sequence; identical to SEQ ID NO: 51945
  neuraminidase__InfluenzaA__AEX35277

SEQ ID NO: 52055 - RNA, 1410 nt, Artificial Sequence
  neuraminidase__InfluenzaA__AEX35288
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacauaauaggaccccuuaucggaccuuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccaggaaaaacgacagcuccagcaguagccauugcuuggauccuaacaaugaagaagguggucauggagugaaaggcugggccuuugaugauggaaaugacguguggaugggaagaacgaucagcgagaaguugcgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52056 - RNA, 1410 nt, Artificial Sequence; identical to SEQ ID NO: 51953
  neuraminidase__InfluenzaA__AEX35299

SEQ ID NO: 52057 - RNA, 1410 nt, Artificial Sequence
  neuraminidase__InfluenzaA__AEX35310
augaauccaaaucaaaagauaauaacaauuggcucuguuucucucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggagacaucugggugacaagagaaccuuaugugucaugcgauccugacaaguguuaucaauuugcccuuggacagggaacaacacuaaacaacgugcauucaaaugacacagugcaugauaggaccccuuaucggacccuauugaugaaugaguuggguguuccauuucaucugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccuguuauccucgauauccuggugucagaugugucugcagagacaacuggaaaggcuccaauaggcccaucguagauauaaacauaaaagauuauagcauuguuuccaguuaugugugcucaggacuuguuggagacacacccagaaaaaacgacagcuccagcaguagccauugcuuggauccaaacaaugaggaagguggucauggagugaaaggcugggccuuugaugauggagaugacguguggaugggaagaacgaucagcgagaaguuacgcucaggauaugaaaccuucaaagucauugaaggcugguccaacccuaacuccaaauugcagauaaauaggcaagucauaguugacagagguaauagguccgguuauucugguauuuucucuguugaaggcaaaagcugcaucaaucggugcuuuuauguggaguugauaaggggaagaaaccaggaaacugaagucuuguggaccucaaacaguauuguuguguuuuguggcaccucagguacauauggaacaggcucauggccugauggggcggacaucaaucucaugccuauauaa

SEQ ID NO: 52058 - RNA, 1410 nt, Artificial Sequence; identical to SEQ ID NO: 51953
  neuraminidase__InfluenzaA__AEX35321

SEQ ID NO: 52059 - RNA, 1410 nt, Artificial Sequence
  neuraminidase__InfluenzaA__AEX35332
augaauccaaaucaaaagauaauaacgauuggcucuguuucucucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuccaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaagggaaaaucguucauacuagcacauugucaggaagugcucagcaugucgaggagugcuccuguuauccucgauauccuggugucagaugugucugcagagacaauuggaaaggcuccaauaggcccaucguagauauaaacauaaaggauuauagcauuguuuccaguuaugugugcucaggacuuguuggagacacacccagaaaaaacgacaguuccagcaguagccauugcuuggauccaaacaaugaggaagguggucauggagugaaaggcugggcauuugaugauggaaaugacguguggaugggaagaacgaucagcgagaaguuacgcucaggauaugaaaccuucaaagucauugaaggcugguccaacccuaacuccaaauugcagauaaauaggcaagucauaguugacagggguaauagguccgguuauucugguauuuucucuguugaaggcaaaagcugcaucaaucggugcuuuuauguggaguugauaagaggaagaaaacaggaaacugaagucuuguggaccucaaacaguauuguuguguuuuguggcaccucagguacauauggaacaggcucauggccugauggggcggacaucaaucucaugccuauauaa

SEQ ID NO: 52060 - RNA, 1410 nt, Artificial Sequence
  neuraminidase__InfluenzaA__AEX35343
augaauccaaaucaaaagauaauaacgauuggcucuguuucucucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuccaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaagggaaaaucguucauacuagcacauugucaggaagugcucagcaugucgaggagugcuccuguuauccucgauauccuggugucagaugugucugcagagacaauuggaaaggcuccaauaggcccaucguagauauaaacauaaaggauuauagcauuguuuccaguuaugugugcucaggacuuguuggagacacacccagaaaaaacgacagcuccagcaguagccauugcuuggauccaaacaaugaggaagguggucauggagugaaaggcugggccuuugaugauggaaaugacguguggaugggaagaacgaucagcgagaaguuacgcucaggauaugaaaccuucaaagucauugaaggcugguccaacccuaacuccaaauugcagauaaauaggcaagucauaguugacagggguaauagguccgguuauucugguauuuucucuguugaaggcaaaagcugcaucaaucggugcuuuuauguggaguugauaagaggaagaaaacaggaaacugaagucuuguggaccucaaacaguauuguuguguuuuguggcaccucagguacauauggaacaggcucauggccugauggggcggacaucaaucucaugccuauauaa

SEQ ID NO: 52061 - RNA, 1410 nt, Artificial Sequence
  neuraminidase__InfluenzaA__AEX35354
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggaccuuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggaguacuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52062 - RNA, 1410 nt, Artificial Sequence
  neuraminidase__InfluenzaA__AEX35365
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggaccuuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52063 - RNA, 1410 nt, Artificial Sequence
  neuraminidase__InfluenzaA__AEX35376
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugaaaggaccccuuaucggaccuuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52064 - RNA, 1410 nt, Artificial Sequence; identical to SEQ ID NO: 52062
  neuraminidase__InfluenzaA__AEX35387

SEQ ID NO: 52065 - RNA, 1410 nt, Artificial Sequence
  neuraminidase__InfluenzaA__AEX35398
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaauuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuugugcaguaguaaugacugaugggagugcuucaggaaaagcugauacuaaaauacuauucauugaggaggggaaaaucguucauacuagcacauugucaggaagugcucagcaugucgaggagugcuccugcuacccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaacugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52066 - RNA, 1410 nt, Artificial Sequence; identical to SEQ ID NO: 51953
  neuraminidase__InfluenzaA__AEX35409

SEQ ID NO: 52067 - RNA, 1410 nt, Artificial Sequence; identical to SEQ ID NO: 52055
  neuraminidase__InfluenzaA__AEX35420

SEQ ID NO: 52068 - RNA, 1410 nt, Artificial Sequence
  neuraminidase__InfluenzaA__AEX35431
augaauccaaaucaaaagauaauaacgauuggcucuguuucucucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguauuguuucaugguccaaaaaaauccucaggacccaggagucagaauguguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaaugcuccuguuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaauuacgcucaggauaugaaaccuucaaagucauugaaggcugguccaacccuaacuccaaauugcagauaaauaggcaagucauaguugacagagguaauagguccgguuauucugguauuuucucuguugaaggcaaaagcugcaucaaucggugcuuuuauguggaguugauaaggggaagaaaaaaggaaacugaagucuuguggaccucaaacaguauuguuguguuuuguggcaccucagguacauauggaacaggcucauggccugauggggcggacaucaaucucaugccuauauaa

SEQ ID NO: 52069 - RNA, 1410 nt, Artificial Sequence; identical to SEQ ID NO: 45232
  neuraminidase__InfluenzaA__AEX35453

SEQ ID NO: 52070 - RNA, 1410 nt, Artificial Sequence
  neuraminidase__InfluenzaA__AEX35464
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucgaacaguauuguuguguuuuguggcaccucagguacauauggaacaggcucauggccugauggggcggacaucaaucucaugccuauauaa

SEQ ID NO: 52071 - RNA, 1410 nt, Artificial Sequence
  neuraminidase__InfluenzaA__AEX35475
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucaugauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuucuaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52072 - RNA, 1410 nt, Artificial Sequence; identical to SEQ ID NO: 45232
  neuraminidase__InfluenzaA__AEX35486

SEQ ID NO: 52073 - RNA, 1410 nt, Artificial Sequence
  neuraminidase__InfluenzaA__AEX35497
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaaaaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52074 - RNA, 1410 nt, Artificial Sequence
  neuraminidase__InfluenzaA__AEX35508
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuucuaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52075 - RNA, 1410 nt, Artificial Sequence
  neuraminidase__InfluenzaA__AEX35519
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaaaaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagaggcaauagguccgguuauucugguauuuucucuguugaaggcaaaagcugcaucaaucggugcuuuuauguggaguugauaaggggaagaaaagaggaaacugaagucuuguggaccucaaacagcauuguuguguuuuguggcaccucagguacauauggaacaggcucauggccugauggggcggacaucaaucucaugccuauauaa

SEQ ID NO: 52076 - RNA, 1410 nt, Artificial Sequence
  neuraminidase__InfluenzaA__AEX35530
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcagugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucagggaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacacaaaggauuauagcauuguuuccaguuaugugugcucaggacuuguuggagacacacccagaaaaaacgacagcuccagcaguagccauugcuugaauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagauaaauaggcaagucauaguugacagagguaauagauccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52077 - RNA, 1410 nt, Artificial Sequence; identical to SEQ ID NO: 45232
  neuraminidase__InfluenzaA__AEX35541

SEQ ID NO: 52078 - RNA, 1410 nt, Artificial Sequence
  neuraminidase__InfluenzaA__AEX35552
augaauccaaaucaaaagauaauaacgauuggcucugcuucucucaccauuuccacaauaugcuucuucaugcaaauugccaucuugauaacuacuguaacauugcauuuuaagcaauaugaauucaacccccccccaaacaaccaagcgaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaauuagguguuccauuucaucuggggaccaagcaagugugcauagcaugguccagcucaaguugucacgauggaaaagcauggcugcauguuuguguaacgggggacgauaaaaaugcaacugcuagcuucauuuacaaugggaggcuuguagauagcauuguuucaugguccaaagaaauccucaggacccaggagucagaaugcguuuguaucaauggaacuuguacaguaguaaugaccgaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauugcuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52079 - RNA, 1410 nt, Artificial Sequence
  neuraminidase__InfluenzaA__AEX35563
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaaugcuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacaggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucagggaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuugaauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagauaaauaggcaagucauaguugacagagguaauagauccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52080 - RNA, 1410 nt, Artificial Sequence
  neuraminidase__InfluenzaA__AEX35585
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuugugugacgggggaugauaaaaaugcaacugcuagcuucauuuacaaugggaggcuuguagauaguauuguuucaugguccaaagaaauccucaggacccaggagucagaaugcguuuguaucgauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52081 - RNA, 1410 nt, Artificial Sequence
  neuraminidase__InfluenzaA__AEX35596
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaaggaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccugauuccaaauugcagauaaauaggcaagucauaguugacagagguaauagguccgguuauucugguauuuucuccguugaaggcaaaagcugcaucaaucggugcuuuuauguggaguugauaaggggaagaaaagaggaaacugaagucuuguggaccucgaacaguauuguuguguuuuguggcaccucagguacauauggaacaggcucauggccugauggggcggacaucaaucucaugccuauauaa

SEQ ID NO: 52082 - RNA, 1410 nt, Artificial Sequence; identical to SEQ ID NO: 52071
  neuraminidase__InfluenzaA__AEX35607

SEQ ID NO: 52083 - RNA, 1410 nt, Artificial Sequence
  neuraminidase__InfluenzaA__AEX35618
augaauccaaaucaaaagauaauaacgauuggcucuguuucucucaccauuuccacaauaugcuucuucaugcaaauugccaucuugauaacuacuguaacauugcauuucaagcaauaugaacucaacucccccccaaacaaccaagugaugcugugugaaccaacaauaauagaaagaaacauaacagagauaguguaucugaccaacaccaccauagagaaggaaacaugccccaaacuagcagaauacagaaauuggucaaagccgcaauguuacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagauaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52084 - RNA, 1410 nt, Artificial Sequence
  neuraminidase__InfluenzaA__AEX35640
augaauccaaaucaaaagauaauaacgauuggcucuguuucucucaccauuuccacaauaugcuucuucaugcaaauugccaucuuaauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaaguggucaaagccgcaauguaauauuacaggauuugcaccuuuuucuaaggacaauucgauuaggcuuuccgcugguggggacauuugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccauuucaucuggggaccaagcaagugugcauagcaugguccagcucaaguugucacgauggaaaagcauggcugcauguuuguguaacgggggauaauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggagaggcuccaauaggcccauaguagauauaaacaugaaggauuauagcauuguuuccaguuaugugugcucaggacuuguuggagacacacccagaaaaaacgacagcuccagcaguggccauugcuuggauccuaacgaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52085 - RNA, 1410 nt, Artificial Sequence
  neuraminidase__InfluenzaA__AEX35651
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaagacaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52086 - RNA, 1410 nt, Artificial Sequence
  neuraminidase__InfluenzaA__AEX36105
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggggacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuauggaccucaaacaguauuguuguguuuuguggcaccucagguacauauggaacaggcucauggccugauggggcggacaucaaucucaugccuauauaa

SEQ ID NO: 52087 - RNA, 1410 nt, Artificial Sequence
  neuraminidase__InfluenzaA__AEX36116
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguauuugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacguaauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggagaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucugguacauauggaacaggcucauggccugauggggcggacaucaaucucaugccuauauaa

SEQ ID NO: 52088 - RNA, 1410 nt, Artificial Sequence
  neuraminidase__InfluenzaA__AEX36127
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauugguuaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggagaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaauugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52089 - RNA, 1410 nt, Artificial Sequence
  neuraminidase__InfluenzaA__AEX36149
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguauuaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaagacaaaagcugcaucaaucggugcuuuuauguggaguugauaaggggaagaaaagaggaaacugaagucuuguggaccacaaacaguauuguuguguuuuguggcaccucagguacauauggaacaggcucauggccugauggggcggacaucaaucucaugccuauauaa

SEQ ID NO: 52090 - RNA, 1410 nt, Artificial Sequence
  neuraminidase__InfluenzaA__AEX36160
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuaguuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52091 - RNA, 1410 nt, Artificial Sequence
  neuraminidase__InfluenzaA__AEX36171
augaauccaaaucaaaagauaauaacgauuggcucuguuucucucaccauuuccacaauaugcuucuucaugcaaauugccaucuugauaacuacuguaacauugcauuucaagcaauaugaauucagcucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucuggguaacaagagaaccuuaugugucaugcgauccugacaaguguuaucaauuugcccuuggacagggaacaacacuaaacaacgugcauucaaaugacacaguacauaauaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuugugcaguaguaaugacugaugggagugcuucaggaaaagcugauacuaaaauauuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaaacgacagcuccagcaguagccauuguuuggauccuaacaaugaagaagguggucauggagugaaaggcugggccuuugaugauggagaugacguauggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaaguuuuguggaccucaaacaguauuguuguguuuuguggcaccucagguacauauggaacaggcucauggccugauggggcggacaucaaucucaugccuauauaa

SEQ ID NO: 52092 - RNA, 1410 nt, Artificial Sequence
  neuraminidase__InfluenzaA__AEX36193
augaauccaaaucaaaagauaauaacgauuggcucuguuucucucaccauuuccacaauaugcuucuucaugcaaauugccaucuugauaacuacuguaacauugcauuucaagcaauaugaauucaacuccuccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagucugcauagcaugguccagcucaaguugucacgauggaaaagcauggcugcauguuuguauaacgggggaugauaaaaaugcaacugcuagcuucauuuacaaugggaugcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52093 - RNA, 1410 nt, Artificial Sequence
  neuraminidase__InfluenzaA__AEX36204
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccagcaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugagaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaccgaaguuuuguggaccucaaacaguauuguuguguuuuguggcaccucagguacauauggaacaggcucauggccugauggggcggacaucaaucucaugccuauauaa

SEQ ID NO: 52094 - RNA, 1410 nt, Artificial Sequence
  neuraminidase__InfluenzaA__AEX36215
augaauccaaaucaaaagauaauaacgauuggcucuguuucucucaccauuuccacaauaugcuucuucaugcaaauugccaucuugauaacuacuguaacauugcauuucaagcaauaugaauucagcucccccccaaacaaccaagugaugcugugugaaccagcaauaauagaaaaaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugagaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaccgaaguuuuguggaccucaaacaguauuguuguguuuuguggcaccucagguacauauggaacaggcucauggccugauggggcggacaucaaucucaugccuauauaa

SEQ ID NO: 52095 - RNA, 1410 nt, Artificial Sequence
  neuraminidase__InfluenzaA__AEX36226
augaauccaaaucaaaagauaauaacgauuggcucuguuucccucaccauuuccacaauaugcuucuucaugcaaauugccaucuugauaacuacuguaacauugcauuucaagcaauaugaauucagcucccccccaaacaaccaagugaugcugugugaaccagcaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacauaauaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguggauauaaacauaaaggauuauagcauuguuuccagauaugugugcucaggaauuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaccgaaguuuuguggaccucaaacaguauuguuguguuuuguggcaccucagguacauauggaacaggcucauggccugauggggcggacaucaaucucaugccuauauaa

SEQ ID NO: 52096 - RNA, 1410 nt, Artificial Sequence
  neuraminidase__InfluenzaA__AEX36237
augaauccaaaucaaaagauaauaacgauuggcucuguuucucucaccauuuccacaauaugcuucuucaugcaaauugccaucuuaauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaaguggucaaagccgcaauguaauauuacaggauuugcaccuuuuucuaaggacaauucgauuaggcuuuccgcugguggggacauuugggugacaagagaaccuuaugugucaugcgauccugacaaguguuaucaauuugcccuuggacagggaacaacacuaaacaacgugcauucaaaugacacaguacgugaaaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggagaggcuccaauaggcccauaguagauauaaacaugaaggauuauagcauuguuuccaguuaugugugcucaggacuuguuggagacacacccagaaaaaacgacagcuccagcaguggccauugcuuggauccuaacgaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52097 - RNA, 1410 nt, Artificial Sequence
  neuraminidase__InfluenzaA__AEX36248
augaauccaaaucaaaagauaauaacgauuggcucuguuucccucaccauuuccacaauaugcuucuucaugcaaauugccaucuugauaacuacuguaacauugcauuucaagcaauaugaauucagcucccccccaaacaaccaagugaugcugugugaaccagcaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacauaauagaaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaagagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaccgaaguuuuguggaccucaaacaguauugucguguuuuguggcaccucagguacauauggaacaggcucauggccugauggggcggacaucaaucucaugccuauauaa

SEQ ID NO: 52098 - RNA, 1410 nt, Artificial Sequence; identical to SEQ ID NO: 47018
  neuraminidase__InfluenzaA__AEX36259

SEQ ID NO: 52099 - RNA, 1410 nt, Artificial Sequence
  neuraminidase__InfluenzaA__AEX36270
augaauccaaaucaaaagauaauaacgauuggcucuguuucucucaccauuuccacaauaugcuucuucaugcaaauugccaucuugauaacuacuguaacauugcauuucaagcaauaugaauucagcucccccccaaacaaccaagugaugcugugugaaccagcaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugguaggaccccuuaucggacccuauugaugaaugagcuagguguuccauuucaucuggggaccaagcaagugugcauagcaugguccagcucaaguugucacgauggaaaagcauggcugcauguuuguguaacgggagaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucagggaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguuaauaaggggaagagaagaggaaaccaaaguuuuguggaccucaaacaguauuguuguguuuuguggcaccucagguacauauggaacaggcucauggccugauggggcggacaucaaucucaugccuauauaa

SEQ ID NO: 52100 - RNA, 1410 nt, Artificial Sequence
  neuraminidase__InfluenzaA__AEX36281
augaauccaaaucaaaagauaauaacgauuggcucuguuucucucaccauuuccacaauaugcuucuucaugcaaauugcuaucuugauaacuacuguaacauugcauuucaagcaauaugaauucagcucccccccaaacaaccaagugaugcugugugaaccagcaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugguaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaccgaaguuuuguggaccucaaacaguauuguuguguuuuguggcaccucagguacauauggaacaggcucauggccugauggggcggacaucaaucucaugccuauauaa

SEQ ID NO: 52101 - RNA, 1410 nt, Artificial Sequence; identical to SEQ ID NO: 52100
  neuraminidase__InfluenzaA__AEX36292

SEQ ID NO: 52102 - RNA, 1410 nt, Artificial Sequence
  neuraminidase__InfluenzaA__AEX36303
augaauccaaaucaaaagauaauaacgauuggcucuguuucucucaccauuuccacaauaugcuucuucaugcaaauugccaucuugauaacuacuguaacauugcauuucaagcaauaugaauucagcucccccccaaacaaccaagugaugcugugugaaccagcaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugagaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaauaguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaccgaaguuuuguggaccucaaacaguauuguuguguuuuguggcaccucagguacauauggaacaggcucauggccugauggggcggacaucaaucucaugccuauauaa

SEQ ID NO: 52103 - RNA, 1410 nt, Artificial Sequence
  neuraminidase__InfluenzaA__AEX36314
augaauccaaaucaaaagauaauaacgauuggcucuguuucucucaccauuuccacaauaugcuucuucaugcaaauugccaucuugauaacuacuguaacauugcauuucaagcaauaugaauucagcucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacauaauaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuugugcaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccauaguagauauaaacauaaaggauuauagcauuguuuccagauaugugugcucaggacuuguuggagacacacccagaaaaaacgacagcuccagcaguagccauugcuuggauccuaacaaugaagaaggugaucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaaguuuuguggaccucaaacaguauuguuguguuuuguggcaccucagguacauauggaacaggcucauggccugauggggcggaaaucaaucucaugccuauauaa

SEQ ID NO: 52104 - RNA, 1410 nt, Artificial Sequence
  neuraminidase__InfluenzaA__AEX36336
augaauccaaaucaaaagauaauaacgauuggcucuguuucucucaccauuuccacaauaugcuucuucaugcaaauugccaucuugauaacuacuguaacauugcauuucaagcaauaugaauucagcucccccccaaacaaccaagugaugcugugugaaccagcaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugguaggaccccuuaucggacccuauugaugaaugaacuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaccgaaguuuuguggaccucaaacaguauuguuguguuuuguggcaccucagguacauauggaacaggcucauggccugauggggcggacaucaaucucaugccuauauaa

SEQ ID NO: 52105 - RNA, 1410 nt, Artificial Sequence
  neuraminidase__InfluenzaA__AEX36347
augaauccaaaucaaaagauaauaacgauuggcucuguuucucucaccauuuccacaauaugcuucuucaugcaaauugccaucuugauaacuacuguaacauugcauuucaagcaauaugaauucagcucccccccaaacaaccaagugaugcugugugaaccaauaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucaauuaggcuuuccgcugguggggacaucugggugacaagagaaccuuaugugucaugcgauccugacaaguguuaucaauuugcccuuggacagggaacaacacuaaacaacgugcauucaaaugacacaguacauaauaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuugugcaguaguaaugacugaugggagugcuucaggaaaagcugauacuaaaauacuauucauugaggaggggaaaaucguucaugcuagcacauugucaggaagugcucagcaugucgaggagugcuccugcuauccucgauauccuggugucagaugugucugcagagacaauuggaaaggcuccaauaggcccauuguagauauaaacauaaaggauuauagcauuguuucuagauaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgaaaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaaguuuuguggaccucaaacaguauuguuguguuuuguggcaccucagguacauauggaacaggcucauggccugauggggcggacaucaaucucaugccuauauaa

SEQ ID NO: 52106 - RNA, 1410 nt, Artificial Sequence
  neuraminidase__InfluenzaA__AEX36358
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaagauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuauggaccucaaacaguauuguuguguuuuguggcaccucagguacauauggaacaggcucauggccugauggggcggacaucaaucucaugccuauauaa

SEQ ID NO: 52107 - RNA, 1410 nt, Artificial Sequence
  neuraminidase__InfluenzaA__AEX36369
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacguaauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauaggaccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52108 - RNA, 1410 nt, Artificial Sequence
  neuraminidase__InfluenzaA__AEX36391
augaauccaaaucaaaagauaauaacgauuggcucuguuucucucaccauuuccacaauaugcuucuucaugcaaauugccaucuugauaaccacuguaacauugcauuucaagcaauaugaauucaacucccccccaaacaaccaagugaugcugugugaaccaacaauaauagaaagaaacauaacagagauaguguaucugaccaacaccaccauagagaaggagauaugccccaaacuagcagaauacagaaauuggucaaagccgcaaugugacauugcaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacguaauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52109 - RNA, 1410 nt, Artificial Sequence
  neuraminidase__InfluenzaA__AEX36402
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugguaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauucccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauaggaccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52110 - RNA, 1410 nt, Artificial Sequence
  neuraminidase__InfluenzaA__AEX36413
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuauggaccucaaacaguauuguuguguuuuguggcaccucagguacauauggaacaggcucauggccugauggggcggacaucaaucucaugccuauauaa

SEQ ID NO: 52111 - RNA, 1410 nt, Artificial Sequence
  neuraminidase__InfluenzaA__AEX36424
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugcuccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaauacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52112 - RNA, 1410 nt, Artificial Sequence
  neuraminidase__InfluenzaA__AEX36435
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugacaccaaaauacuauucauuaaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacuccaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52113 - RNA, 1410 nt, Artificial Sequence; identical to SEQ ID NO: 46582
  neuraminidase__InfluenzaA__AEX36446

SEQ ID NO: 52114 - RNA, 1410 nt, Artificial Sequence; identical to SEQ ID NO: 46582
  neuraminidase__InfluenzaA__AEX36457

SEQ ID NO: 52115 - RNA, 1410 nt, Artificial Sequence
  neuraminidase__InfluenzaA__AEX36468
augaauccaaaucaaaagauaauaacgauuggcucuguuucucucaccauuuccacaauaugcuucuucaugcaaauugccaucuugauaacuacuguaacauugcauuucaagcaauaugaauucagcucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacauaauaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaaaugcucagcaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaccaaaguuuuguggaccucaaacaguauuguuguguuuuguggcaccucagguacauauggaacaggcucauggccugauggggcggacaucaaucucaugccuauauaa

SEQ ID NO: 52116 - RNA, 1410 nt, Artificial Sequence
  neuraminidase__InfluenzaA__AEX36479
augaauccaaaucaaaagauaauaacgauuggcucuguuucucucaccauuuccacaauaugcuucuucaugcaaauugccaucuugauaacuacuguaacauugcauuucaagcaauaugaauucagcucccccccaaacaaccaagugaugcugugugaaccaacaauaauagaaagaaacauaacagagauaguguauccgaccaacaccaccacagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaccgaaguuuuguggaccucaaacaguauuguuguguuuuguggcaccucagguacauauggaacaggcucauggccugauggggcggacaucaaucucaugccuauauaa

SEQ ID NO: 52117 - RNA, 1410 nt, Artificial Sequence
  neuraminidase__InfluenzaA__AEX36490
augaauccaaaucaaaagauaauaacgauuggcucuguuucucucaccauuuccacaauaugcuucuucaugcaaauugccaucuugauaacuacuguaacauugcauuucaagcaauaugaauucagcuaccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaaaugcucagcaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaccaaaguuuuguggaccucaaacaguauuguuguguuuuguggcaccucagguacauauggaacaggcucauggccugauggggcggacaucaaucucaugccuauauaa

SEQ ID NO: 52118 - RNA, 1410 nt, Artificial Sequence
  neuraminidase__InfluenzaA__AEX36501
augaauccaaaucaaaagauaauaacgauuggcucuguuucucucaccauuuccacaauaugcuucuucaugcaaauugccaucuugauaacuacuguaacauugcauuucaagcaauaugaauucagcucccccccaaacaaccaagugaugcugugugaaccagcaauaauagaaagaaacauaacagagauaguguaucugaccaacaccaccauagagaaggaaaaaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugguaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaagcgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaccgaaguuuuguggaccucaaacaguauuguuguguuuuguggcaccucagguacauauggaacaggcucauggccugauggggcggacaucaaucucaugccuauauaa

SEQ ID NO: 52119 - RNA, 1410 nt, Artificial Sequence
  neuraminidase__InfluenzaA__AEX36512
augaauccaaaucaaaagauaauaacgauuggcucuguuucccucaccauuuccacaauaugcuucuucaugcaaauugccaucuugauaacuacuguaacauugcauuucaagcaauaugaauucagcucccccccaaacaaccaagugaugcugugugaaccagcaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauugucuccagauaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcauuaaucggugcuuuuauguggaguugauaaggggaagaaaagaggaaaccgaaguuuuguggaccucaaacaguauuguuguguuuuguggcaccucagguacauauggaacaggcucauggccugauggggcggacaucaaucucaugccuauauaa

SEQ ID NO: 52120 - RNA, 1410 nt, Artificial Sequence
  neuraminidase__InfluenzaA__AEX36523
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggagaagcugauacuaaaauacuauucauugaggaggggaaaaucguccauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagggacauauggaacaggcucauggccugauggggcggacaucaaucucaugccuauauaa

SEQ ID NO: 52121 - RNA, 1410 nt, Artificial Sequence
  neuraminidase__InfluenzaA__AEX36534
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauaccagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52122 - RNA, 1410 nt, Artificial Sequence
  neuraminidase__InfluenzaA__AEX36545
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuaguuucauuuacaaugggaggcuuguagauaguguuguuucaugguccaaagaaauccucaggacccaggagucagaaugcguuuguaucaauggaacuuguacaguaguaaugacugaugggagugcuuuaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52123 - RNA, 1410 nt, Artificial Sequence
  neuraminidase__InfluenzaA__AEX36556
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuaguuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucuuaugccuauauaa

SEQ ID NO: 52124 - RNA, 1410 nt, Artificial Sequence; identical to SEQ ID NO: 52123
  neuraminidase__InfluenzaA__AEX36567

SEQ ID NO: 52125 - RNA, 1410 nt, Artificial Sequence
  neuraminidase__InfluenzaA__AEX36578
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugcgacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucgggaaaagcugauacuaaaauacuauucauuaaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucgaacaguauuguuguguuuuguggcaccucagguacauauggaacaggcucauggccugauggggcggacaucaaucucaugccuauauaa

SEQ ID NO: 52126 - RNA, 1410 nt, Artificial Sequence
  neuraminidase__InfluenzaA__AEX36589
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugucccaaacuagcagaauacagaaauuggucaaagccgcaaugcgacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucgggaaaagcugauacuaaaauacuauucauuaaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucgaauaguauuguuguguuuuguggcaccucagguacauauggaacaggcucauggccugauggggcggacaucaaucucaugccuauauaa

SEQ ID NO: 52127 - RNA, 1410 nt, Artificial Sequence
  neuraminidase__InfluenzaA__AEX36600
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaauuagcagaauacagaaauuggucaaagccgcaaugcgacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucgggaaaagcugauacuaaaauacuauucauuaaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaauaacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggacaucgaacaguauuguuguguuuuguggcaccucagguacauauggaacaggcucauggccugauggggcggacaucaaucucaugccuauauaa

SEQ ID NO: 52128 - RNA, 1410 nt, Artificial Sequence; identical to SEQ ID NO: 52062
  neuraminidase__InfluenzaA__AEX36622

SEQ ID NO: 52129 - RNA, 1410 nt, Artificial Sequence
  neuraminidase__InfluenzaA__AEX63619
augaauccaaaucagaagauaauaaccauugguucgaucuguaugacaauuggaauagccagcuugauauuacaaauugggaacauaauaucaauauggauuagccacucaauucaaacugagaaucaaaaucagccugaaauaugcaaucaaaacgucauuacuuacgaaaacaacacuugggucaaccagacguauguuaacgucagcaacacuaauuuuguugcugaacaggcaguagcuucagugaaauuagcgggcaauuccucucucuguccuguuaguggaugggcuauauacaguaaagauaauaguguaagaaucgguuccaagggggauguguuugucauaagggagccauucauuucaugcucccacucggaaugcagaacuuucuucuuaacucaaggggcccuucugaaugacaaacauucuaacggaacaauuaaggacagaagcccauaucgaacauugaugagcuguccuauuggugagguuccuucuccauacaacucaagguuugagucagucgcuuggucagcaagugccugccaugauggcacaaguuggcuaacaauuggaauuucuggcccagauaauggggcaguggcugugcugaaauacaauggcauaauaacagacacuaucaagaguuggagaaagaacauauuaagaacacaagagucugaaugugcaugcguuaaugguucuugcuuuacaguaaugacugauggaccaaguaaugggcaggccucguacaaggucuuuaagauagaaagggggaaaguagucaaaucaguugaguugaaugccccuaauuaucacuaugaggaaugcuccuguuauccugaaucuagugaaaucacauguguguguagagauaauuggcauggcucaaaucggccgugggugucauuuaaucagaaucuggaauaucaaaugggauacauaugcagugggauuuucggagauaauccacgcccuaaugacaaaacaggcaguugugguccaguauuuucuaauggggcaaaugggguaaaaggauuuucauuuaaauacggcaaugguguuuggauagggagaacuaaaagcacuaguucaaggauggguuuugagaugauuugggauccggauggauggaccaaaacagaugauaaauucucaguaaagcaagauaucauaggaauaacugauuggucaggauacagugggaguuuuguucaacacccggaauugaccggacuggacuguaugaggccuugcuuuuggguugaacuaaucagagggcgacccaaagagaacacaaucuggacuagcgggaguagcauauccuuuugugguguaaauagugacacaguggguuggucuuggccagacggugcugaauugccauucaccauugacaaguaa

SEQ ID NO: 52130 - RNA, 1365 nt, Artificial Sequence; identical to SEQ ID NO: 46223
  neuraminidase__InfluenzaA__AEX92876

SEQ ID NO: 52131 - RNA, 1365 nt, Artificial Sequence; identical to SEQ ID NO: 47198
  neuraminidase__InfluenzaA__AEX92887

SEQ ID NO: 52132 - RNA, 1365 nt, Artificial Sequence; identical to SEQ ID NO: 47198
  neuraminidase__InfluenzaA__AEX92904

SEQ ID NO: 52133 - RNA, 1365 nt, Artificial Sequence; identical to SEQ ID NO: 47198
  neuraminidase__InfluenzaA__AEX96924

SEQ ID NO: 52134 - RNA, 1410 nt, Artificial Sequence
  neuraminidase__InfluenzaA__AEY69091
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguauaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52135 - RNA, 1410 nt, Artificial Sequence
  neuraminidase__InfluenzaA__AEY69101
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaacuuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52136 - RNA, 1410 nt, Artificial Sequence
  neuraminidase__InfluenzaA__AEY69112
augaauccaaaucaaaagauaauaacgauuggcucuguuucucucaccauuuccacaauaugcuucuucaugcaaauugccaucuugauaacuacugugacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauacccuggugucagaugugucugcagagacaacuggaaaggauccaauaggcccaucguagauauaaacauaaaggaucauagcauugucuccaguuauguuuguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucuggcauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52137 - RNA, 1410 nt, Artificial Sequence
  neuraminidase__InfluenzaA__AEY69145
augaauacaaaccaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcucuuggacaaggaacaacaauaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacuuugucaggaagugcucagcaugucgaggagugcuccugcuauccucgauauccuggugucagaugcgucugcagagacaacuggaaaggcuccaauaggcccaucguagauauaaacaugaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucuggcauuuucucuguugaaggcaaaagcugcaucaaucggugcuuuuauguggaguugauaaggggaagaaaagaggaaacugaaguuuuguggaccucaaacaguguuguuguguuuuguggcaccucagguacauauggaacaggcucauggccugauggggcggacaucaaucucaugccuauauaa

SEQ ID NO: 52138 - RNA, 1410 nt, Artificial Sequence; identical to SEQ ID NO: 51413
  neuraminidase__InfluenzaA__AEY69156

SEQ ID NO: 52139 - RNA, 1410 nt, Artificial Sequence
  neuraminidase__InfluenzaA__AEY69167
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggagggaaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuguauaa

SEQ ID NO: 52140 - RNA, 1410 nt, Artificial Sequence; identical to SEQ ID NO: 52139
  neuraminidase__InfluenzaA__AEY69178

SEQ ID NO: 52141 - RNA, 1410 nt, Artificial Sequence; identical to SEQ ID NO: 52139
  neuraminidase__InfluenzaA__AEY69189

SEQ ID NO: 52142 - RNA, 1410 nt, Artificial Sequence
  neuraminidase__InfluenzaA__AEY69211
augaauccaaaucaaaagauaauaacgauuggcucuguuucucucaccauuuccacaauaugcuucuucaugcaaauugccaucuugauaacuacuguaacauugcauuucaagcaauauaaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggagggaaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuguauaa

SEQ ID NO: 52143 - RNA, 1410 nt, Artificial Sequence
  neuraminidase__InfluenzaA__AEY69233
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaauccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuguauaa

SEQ ID NO: 52144 - RNA, 1410 nt, Artificial Sequence
  neuraminidase__InfluenzaA__AEY69272
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggagggaaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaacugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuguauaa

SEQ ID NO: 52145 - RNA, 1410 nt, Artificial Sequence; identical to SEQ ID NO: 52139
  neuraminidase__InfluenzaA__AEY69283

SEQ ID NO: 52146 - RNA, 1410 nt, Artificial Sequence
  neuraminidase__InfluenzaA__AEY69294
augaauccaaaucaaaagauaauaacgauuggcucuguuucucucaccauuuccacaauaugcuucuucaugcaaaccgccauccugauaacuacuguaacauugcauuucaagcaaugugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucagggaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaaggugguaauggagugaaaggcugggccuuugaugauggaaaugacguguggaugggaagaacgaucagcgagaaaucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaauugauaaggggaaggaaagaggaaacugaagucuuguggaccucaaacaguauuguuguguuuuguggcaccucagguacauauggaacaggcucauggccugauggggcggacaucaaucucaugccuauauaa

SEQ ID NO: 52147 - RNA, 1410 nt, Artificial Sequence; identical to SEQ ID NO: 52146
  neuraminidase__InfluenzaA__AEY69305

SEQ ID NO: 52148 - RNA, 1410 nt, Artificial Sequence; identical to SEQ ID NO: 52146
  neuraminidase__InfluenzaA__AEY69316

SEQ ID NO: 52149 - RNA, 1410 nt, Artificial Sequence; identical to SEQ ID NO: 52146
  neuraminidase__InfluenzaA__AEY69788

SEQ ID NO: 52150 - RNA, 1410 nt, Artificial Sequence; identical to SEQ ID NO: 51413
  neuraminidase__InfluenzaA__AEY69799

SEQ ID NO: 52151 - RNA, 1410 nt, Artificial Sequence; identical to SEQ ID NO: 51413
  neuraminidase__InfluenzaA__AEY69810

SEQ ID NO: 52152 - RNA, 1410 nt, Artificial Sequence; identical to SEQ ID NO: 52139
  neuraminidase__InfluenzaA__AEY69832

SEQ ID NO: 52153 - RNA, 1410 nt, Artificial Sequence
  neuraminidase__InfluenzaA__AEY69843
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauagcgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggagggaaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuguauaa

SEQ ID NO: 52154 - RNA, 1410 nt, Artificial Sequence
  neuraminidase__InfluenzaA__AEY69854
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggagggaaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcucuagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuguauaa

SEQ ID NO: 52155 - RNA, 1410 nt, Artificial Sequence
  neuraminidase__InfluenzaA__AEY69876
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuaggugucccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggagggaaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuguauaa

SEQ ID NO: 52156 - RNA, 1410 nt, Artificial Sequence; identical to SEQ ID NO: 52155
  neuraminidase__InfluenzaA__AEY69887

SEQ ID NO: 52157 - RNA, 1410 nt, Artificial Sequence
  neuraminidase__InfluenzaA__AEY69898
augaacccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuaggugucccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggagggaaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuguauaa

SEQ ID NO: 52158 - RNA, 1410 nt, Artificial Sequence; identical to SEQ ID NO: 51413
  neuraminidase__InfluenzaA__AEY69909

SEQ ID NO: 52159 - RNA, 1410 nt, Artificial Sequence
  neuraminidase__InfluenzaA__AEY69942
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgaugguggggacaucugggugacaagagaaccuuaugugucaugcgauccugacaaguguuaucaauuugcccuuggacagggaacaacacuaaacaacauacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggagggaaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuguauaa

SEQ ID NO: 52160 - RNA, 1410 nt, Artificial Sequence; identical to SEQ ID NO: 52159
  neuraminidase__InfluenzaA__AEY69953

SEQ ID NO: 52161 - RNA, 1410 nt, Artificial Sequence; identical to SEQ ID NO: 52159
  neuraminidase__InfluenzaA__AEY69964

SEQ ID NO: 52162 - RNA, 1410 nt, Artificial Sequence; identical to SEQ ID NO: 52139
  neuraminidase__InfluenzaA__AEY69975

SEQ ID NO: 52163 - RNA, 1410 nt, Artificial Sequence; identical to SEQ ID NO: 52139
  neuraminidase__InfluenzaA__AEY69986

SEQ ID NO: 52164 - RNA, 1410 nt, Artificial Sequence; identical to SEQ ID NO: 52139
  neuraminidase__InfluenzaA__AEY69997

SEQ ID NO: 52165 - RNA, 1410 nt, Artificial Sequence; identical to SEQ ID NO: 52139
  neuraminidase__InfluenzaA__AEY70008

SEQ ID NO: 52166 - RNA, 1410 nt, Artificial Sequence; identical to SEQ ID NO: 52139
  neuraminidase__InfluenzaA__AEY70019

SEQ ID NO: 52167 - RNA, 1410 nt, Artificial Sequence
  neuraminidase__InfluenzaA__AEY70259
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggagggaaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacucguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuguauaa

SEQ ID NO: 52168 - RNA, 1410 nt, Artificial Sequence; identical to SEQ ID NO: 52139
  neuraminidase__InfluenzaA__AEY70270

SEQ ID NO: 52169 - RNA, 1410 nt, Artificial Sequence; identical to SEQ ID NO: 52139
  neuraminidase__InfluenzaA__AEY70281

SEQ ID NO: 52170 - RNA, 1410 nt, Artificial Sequence; identical to SEQ ID NO: 49755
  neuraminidase__InfluenzaA__AEY70303

SEQ ID NO: 52171 - RNA, 1410 nt, Artificial Sequence; identical to SEQ ID NO: 49755
  neuraminidase__InfluenzaA__AEY70314

SEQ ID NO: 52172 - RNA, 1410 nt, Artificial Sequence
  neuraminidase__InfluenzaA__AEY70325
augaauccaaaucaaaagauaauaacgauuggcucuguuucucucaccauuuccacaauaugcuucuucaugcaaauugccaucuugaugacuacuguaacauugcauuucaagcaauaugaauucaacccccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggagggaaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuguauaa

SEQ ID NO: 52173 - RNA, 1410 nt, Artificial Sequence
  neuraminidase__InfluenzaA__AEY70336
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggagggaaaaaucguucauacuagcacauugucaggaagugcucagcaugucgaggagugcuccugcuauccucgauauccuggugucagauguaucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaauccuaaguccaaauugcagauaaauaggcaagucauaguugacagagguaauagguccgguuauucugguauuuucucuguugaagacaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuguauaa

SEQ ID NO: 52174 - RNA, 1410 nt, Artificial Sequence; identical to SEQ ID NO: 47242
  neuraminidase__InfluenzaA__AEY70358

SEQ ID NO: 52175 - RNA, 1410 nt, Artificial Sequence
  neuraminidase__InfluenzaA__AEY70379
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacaccguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggagggaaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52176 - RNA, 1410 nt, Artificial Sequence
  neuraminidase__InfluenzaA__AFB70139
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucaagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaacaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52177 - RNA, 1410 nt, Artificial Sequence; identical to SEQ ID NO: 47242
  neuraminidase__InfluenzaA__AFB70141

SEQ ID NO: 52178 - RNA, 1410 nt, Artificial Sequence
  neuraminidase__InfluenzaA__AFB70147
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucaagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccgguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaacaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52179 - RNA, 1410 nt, Artificial Sequence; identical to SEQ ID NO: 47242
  neuraminidase__InfluenzaA__AFB70153

SEQ ID NO: 52180 - RNA, 1410 nt, Artificial Sequence; identical to SEQ ID NO: 47242
  neuraminidase__InfluenzaA__AFB70155

SEQ ID NO: 52181 - RNA, 1410 nt, Artificial Sequence
  neuraminidase__InfluenzaA__AFB70157
augaauccaaaccaaaagauaauaaccauugguucggucuguaugacaauuggaauggcuaacuuaauauuacaaauuggaaacauaaucucaauauggauuagccacucaauucaacuuggggaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcugucccauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52182 - RNA, 1410 nt, Artificial Sequence; identical to SEQ ID NO: 47242
  neuraminidase__InfluenzaA__AFB70159

SEQ ID NO: 52183 - RNA, 1410 nt, Artificial Sequence
  neuraminidase__InfluenzaA__AFB70161
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucaagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaacaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguugguauuggccagacggugcugaguugccauuuaccauugacaaguaa

SEQ ID NO: 52184 - RNA, 1410 nt, Artificial Sequence
  neuraminidase__InfluenzaA__AFB70163
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacgcaaucuggacuagcgggagcagcauauccuuuugugguguaaacagugacacuguggguuggucuuggccagacggugcugaguugccauuuaccauugacaaguaa

SEQ ID NO: 52185 - RNA, 1410 nt, Artificial Sequence
  neuraminidase__InfluenzaA__AFB70169
augaauccaaaccaaaagauaauaaccauugguucggucuguaugacaauuggaauggcuaacuuaauauuacaaauuggaaacauaaucucaauauggauuaaccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52186 - RNA, 1410 nt, Artificial Sequence; identical to SEQ ID NO: 47242
  neuraminidase__InfluenzaA__AFB70199

SEQ ID NO: 52187 - RNA, 1410 nt, Artificial Sequence; identical to SEQ ID NO: 48404
  neuraminidase__InfluenzaA__AFB70209

SEQ ID NO: 52188 - RNA, 1410 nt, Artificial Sequence; identical to SEQ ID NO: 47242
  neuraminidase__InfluenzaA__AFB70219

SEQ ID NO: 52189 - RNA, 1410 nt, Artificial Sequence; identical to SEQ ID NO: 47242
  neuraminidase__InfluenzaA__AFB70229

SEQ ID NO: 52190 - RNA, 1410 nt, Artificial Sequence; identical to SEQ ID NO: 47242
  neuraminidase__InfluenzaA__AFB70239

SEQ ID NO: 52191 - RNA, 1410 nt, Artificial Sequence; identical to SEQ ID NO: 47242
  neuraminidase__InfluenzaA__AFB70249

SEQ ID NO: 52192 - RNA, 1410 nt, Artificial Sequence
  neuraminidase__InfluenzaA__AFB70259
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuaucccgauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52193 - RNA, 1410 nt, Artificial Sequence; identical to SEQ ID NO: 52181
  neuraminidase__InfluenzaA__AFB70269

SEQ ID NO: 52194 - RNA, 1410 nt, Artificial Sequence; identical to SEQ ID NO: 47242
  neuraminidase__InfluenzaA__AFB70279

SEQ ID NO: 52195 - RNA, 1410 nt, Artificial Sequence; identical to SEQ ID NO: 52192
  neuraminidase__InfluenzaA__AFB70289

SEQ ID NO: 52196 - RNA, 1410 nt, Artificial Sequence
  neuraminidase__InfluenzaA__AFB70299
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaaaauagucaaaucagucgaaaugaaugccccuaauuaucacuaugaggaaugcuccuguuauccugauucuagugaaaucacaugugugugcagggauaacuggcaugguucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52197 - RNA, 1410 nt, Artificial Sequence; identical to SEQ ID NO: 47242
  neuraminidase__InfluenzaA__AFB70309

SEQ ID NO: 52198 - RNA, 1410 nt, Artificial Sequence; identical to SEQ ID NO: 52176
  neuraminidase__InfluenzaA__AFB70319

SEQ ID NO: 52199 - RNA, 1410 nt, Artificial Sequence; identical to SEQ ID NO: 47242
  neuraminidase__InfluenzaA__AFB70329

SEQ ID NO: 52200 - RNA, 1410 nt, Artificial Sequence; identical to SEQ ID NO: 48435
  neuraminidase__InfluenzaA__AFB70349

SEQ ID NO: 52201 - RNA, 1410 nt, Artificial Sequence; identical to SEQ ID NO: 48263
  neuraminidase__InfluenzaA__AFB70359

SEQ ID NO: 52202 - RNA, 1410 nt, Artificial Sequence; identical to SEQ ID NO: 48435
  neuraminidase__InfluenzaA__AFB70369

SEQ ID NO: 52203 - RNA, 1410 nt, Artificial Sequence; identical to SEQ ID NO: 48430
  neuraminidase__InfluenzaA__AFB70379

SEQ ID NO: 52204 - RNA, 1410 nt, Artificial Sequence; identical to SEQ ID NO: 47242
  neuraminidase__InfluenzaA__AFB70389

SEQ ID NO: 52205 - RNA, 1410 nt, Artificial Sequence; identical to SEQ ID NO: 48435
  neuraminidase__InfluenzaA__AFB70399

SEQ ID NO: 52206 - RNA, 1410 nt, Artificial Sequence; identical to SEQ ID NO: 47242
  neuraminidase__InfluenzaA__AFB70409

SEQ ID NO: 52207 - RNA, 1410 nt, Artificial Sequence
  neuraminidase__InfluenzaA__AFB77614
augcauccaaaccaagaggucauaagcauuguuucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaaggaucgguuccaagggggauguguuugucauaagggagccauucauaucaugcucccccuuggaaugcagaaccuuuuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagugggagcagcauauccuuuugugguguaaacagugacacuguggguugguuuuggccagacggugcugaguugccauuuaccauugacaaguaa

SEQ ID NO: 52208 - RNA, 1410 nt, Artificial Sequence
  neuraminidase__InfluenzaA__AFB77615
augcauccaaaccaagagauuauaaccuuuguuucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggagccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugaugggcaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagugggagcagcauauccuuuugugguguaaacagugacacuguggguuggucuuggccagacggugcugaguugccauuuaccauugacaaguaa

SEQ ID NO: 52209 - RNA, 1410 nt, Artificial Sequence
  neuraminidase__InfluenzaA__AFB78128
augaauccaaaucaaaagauaauaacgauuggcucuguuucucucacuauugccacaauaugcuuccuuaugcaaauagucauccugguaacuacuguaacauugcauuucaagcaacaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggauaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaaguguguauagcaugguccagcucaaguugucacgauggaaaagcauggcugcauguuuguguaacugggcaugaugaaaaugcaacugcuagcuucauuuacgaugggagacuuguagauaguauugguucaugguccaaaaaaauccucaggacccaggagucggaaugcguuuguaucaauggaacuuguacaguaguaaugacugaugggagugcuucaggaagagcugauacuaaaauacuuuucauugaggaggggaaaaucguucauacuagcaaauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccuggauccuaacaaugaagaagggggucauggagugaaaggcugggccuuugaugauggaaaugacguguggaugggaagaacgaucagcgagaagucacgcucagguuaugaaaccuucaaggucauugaaggcugguccaaaccuaacuccaaauugcagauaaauaggcaagucauaguugaaagagguaauauguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52210 - RNA, 1410 nt, Artificial Sequence
  neuraminidase__InfluenzaA__AFC62078
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaacuauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacgauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggauggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52211 - RNA, 1410 nt, Artificial Sequence
  neuraminidase__InfluenzaA__AFC62079
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauaaucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauucucggagacaauccacgcccuaaugauaagacaggcaguugugguccaguaucaucuaauggagcaaauggaguaaaaggauuuucauucaaauacggcaaugguguuuggguagggagaacuaaaagcauuaguucaagaaacgguuuugagaugauuugggauccgaacggauggacugggacagacaauaacuucucaauaaagcaagauaucguaggaauaaaggaguggucaggauauagcgggaguuuuguucagcauccagaacuaacagggcuggauuguauaagaccuugcuucuggguugaacuaaucagagggcgacccaaagagaacacaaucuggacuagcgggagcaucauauccuuuugugguguaaacagugacacuguggguuggucuuggccagacggugcugaguugccauuuaccauugacaaguaa

SEQ ID NO: 52212 - RNA, 1410 nt, Artificial Sequence
  neuraminidase__InfluenzaA__AFC62080
augaauccaaaccaaaagauaauaaccauugguucggucuguaugacaauuggaauggccaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugauaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucgugggaauaaaugaguggucaggauauagcgggaguuuuguucagcauccagaacuaacagggauggguuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52213 - RNA, 1410 nt, Artificial Sequence
  neuraminidase__InfluenzaA__AFC62082
augaauccaaaccaaaagauaauaacgauuggcucuguuucccucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcggaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacaaggaacaacacuaaacaacgugcauucaaauaacacaguacgugguaggaccccuuaucggacccuauugaugaaugaguuagguguuccuuuucaucuggggaccaagcaagugugcauagcaugguccagcucaaguugucacgauggaaaagcauggcugcauguuuguauaacgggggacgauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucaucgaggaggggaaaaucguucauacuagcacauugucaggaagugcucaacaugucgaggagugcuccugcuauccucgauauccuggugucagaugugucugcagagacaacuggaaaggcuccaauaggcccaucguagauauaaacaugaaggaucauagcauuguuuccaguuauguguguucaggacuuguuggagacacacccagaaaaaacgacagcuccagcaguagccauuguuuugauccuaacgaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauaaggggaaguaaagaggaaacugaaguauuguggaccucaaacaguauuguuguguuuuguggcaccucagggacauauggaacaggcucauggccugauggggcggacaucaaucucaugccuauauaa

SEQ ID NO: 52214 - RNA, 1410 nt, Artificial Sequence; identical to SEQ ID NO: 45276
  neuraminidase__InfluenzaA__AFD63529

SEQ ID NO: 52215 - RNA, 1410 nt, Artificial Sequence; identical to SEQ ID NO: 45276
  neuraminidase__InfluenzaA__AFD63540

SEQ ID NO: 52216 - RNA, 1410 nt, Artificial Sequence
  neuraminidase__InfluenzaA__AFD63551
augaauccaaaucaaaagauaauaacaauuggcucuguuucucucaccauugccgcaauaugcuuccuuaugcaaauugccauccugguaacuacuguaacauugcauuucaagcagcaugaaugcaacccccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugguaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccgauauaa

SEQ ID NO: 52217 - RNA, 1410 nt, Artificial Sequence; identical to SEQ ID NO: 45276
  neuraminidase__InfluenzaA__AFD63562

SEQ ID NO: 52218 - RNA, 1410 nt, Artificial Sequence
  neuraminidase__InfluenzaA__AFD63573
augaauccaaaucaaaagauaauaacaauuggcucuguuucucucacuauugccacaauaugcuuccuuaugcaaauugccauccugguaacuacuguaacauugcauuucaagcagcaugaaugcaacucccccccaaacaaccaaguaaugcugugugaaccaacaauaauaggaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgacccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52219 - RNA, 1410 nt, Artificial Sequence
  neuraminidase__InfluenzaA__AFD63584
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaauaccacuauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagagccuuaugugucaugcgauccugacaaguguuaucaauuugcccuugggcagggaacaacacuaaacaacggacauucaaaugacacaguacaugaaaggaccccuuaccggacccuacugaugaaugaauuggguguuccauuucauuugggaaccaggcaaguguguauagcaugguccagcucaaguugucacgauggaaaagcauggcugcauguuuguguaacuggggaugauaaaaaugcaacugcuaguuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucauucauauuagcacauugucaggaagugcucagcaugucgaggagugcuccuguuauccucgauauccuggugucagauguguaugccgagacaacuggaaaggcuccaauaggcccaucguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52220 - RNA, 1410 nt, Artificial Sequence
  neuraminidase__InfluenzaA__AFD63595
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcaaagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52221 - RNA, 1410 nt, Artificial Sequence; identical to SEQ ID NO: 45276
  neuraminidase__InfluenzaA__AFD63606

SEQ ID NO: 52222 - RNA, 1410 nt, Artificial Sequence
  neuraminidase__InfluenzaA__AFD63628
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgacccugacaaguguuaucaguuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52223 - RNA, 1410 nt, Artificial Sequence
  neuraminidase__InfluenzaA__AFD63639
augaauccaaaucaaaagauaauaacaauuggcucuguuucucucaccauugccgcaauaugcuuccucaugcaaauugccauccugguaacuacuguaacauugcauuucaagcagcaugaaugcaacucccccccaaacaaccaaguaauguugugugaaccaacaauaauagaaagaaacauaacagagauaguguaucugaccaacaccaccauagagaaggaaauaugccccaaacuagcagaauaccgaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52224 - RNA, 1410 nt, Artificial Sequence
  neuraminidase__InfluenzaA__AFD63650
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguagaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52225 - RNA, 1410 nt, Artificial Sequence
  neuraminidase__InfluenzaA__AFD63661
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacuccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52226 - RNA, 1410 nt, Artificial Sequence
  neuraminidase__InfluenzaA__AFD63672
augaauccaaaucaaaagauaauaacaauuggcucuguuucucucaccauugccacaauaugcuuccuuaugcaaauuaccauccugguaacuacuguaacauugcauuucaagcaguaugaaugcaacucccccccaaacaaccaaguaaugcugugugaaccaacaauaauagaaagaaacauaacagagauaguguaucugaccaauaccacuauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagagccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuaguuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucauucauauuagcacauugucaggaagugcucagcaugucgaggagugcuccuguuauccucgauauccuggugucagauguguaugccgagacaacuggaaaggcuccaauaggcccaucguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52227 - RNA, 1410 nt, Artificial Sequence
  neuraminidase__InfluenzaA__AFD63683
augaauccaaaucaaaagauaauaacaaugggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaauaccacuauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagagccuuaugugucaugcgauccugacaaguguuaucaauuugcccuugggcagggaacaacacuaaacaacgggcauucaaaugacacaguacaugguaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuaguuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucauucauauuagcacauugucaggaagugcucagcaugucgaggagugcuccuguuauccucgauauccuggugucagauguguaugccgagacaacuggaaaggcuccaauaggcccaucguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52228 - RNA, 1410 nt, Artificial Sequence
  neuraminidase__InfluenzaA__AFD63694
augaauccaaaucaaaagauaauaacaauuggcucuguuucucucaccauugccacaauaugcuuccuuaugcaaauugccauccugguaacuacuauaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgacccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52229 - RNA, 1410 nt, Artificial Sequence
  neuraminidase__InfluenzaA__AFD63705
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggaagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcauguagaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52230 - RNA, 1410 nt, Artificial Sequence
  neuraminidase__InfluenzaA__AFD63716
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaagugucaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52231 - RNA, 1410 nt, Artificial Sequence
  neuraminidase__InfluenzaA__AFD63727
augaauccaaaucaaaagauaauaacaauuggcucuguuucucucaccauugccgcaauaugcuuccuuaugcaaauugccauccugguaaccacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52232 - RNA, 1410 nt, Artificial Sequence; identical to SEQ ID NO: 52231
  neuraminidase__InfluenzaA__AFD63738

SEQ ID NO: 52233 - RNA, 1410 nt, Artificial Sequence
  neuraminidase__InfluenzaA__AFD63749
augaauccaaaucaaaagauaauaacaauuagcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgacccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52234 - RNA, 1410 nt, Artificial Sequence
  neuraminidase__InfluenzaA__AFD63760
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaauaccacuauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagagccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuaguuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucauucauauuagcacauugucaggaagugcucagcaugucgaggagugcuccuguuauccucgauauccuggugucagauguguaugccgagacaacuggaaaggcuccaauaggcccaucguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52235 - RNA, 1410 nt, Artificial Sequence; identical to SEQ ID NO: 52231
  neuraminidase__InfluenzaA__AFD63771

SEQ ID NO: 52236 - RNA, 1410 nt, Artificial Sequence
  neuraminidase__InfluenzaA__AFD63782
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucagaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggggucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52237 - RNA, 1410 nt, Artificial Sequence; identical to SEQ ID NO: 52234
  neuraminidase__InfluenzaA__AFD63793

SEQ ID NO: 52238 - RNA, 1410 nt, Artificial Sequence
  neuraminidase__InfluenzaA__AFD63804
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccucaauguaacaucacaggauuugcaccuuuuucuaaagacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaauuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52239 - RNA, 1410 nt, Artificial Sequence; identical to SEQ ID NO: 45276
  neuraminidase__InfluenzaA__AFD63815

SEQ ID NO: 52240 - RNA, 1410 nt, Artificial Sequence; identical to SEQ ID NO: 45276
  neuraminidase__InfluenzaA__AFD63826

SEQ ID NO: 52241 - RNA, 1410 nt, Artificial Sequence
  neuraminidase__InfluenzaA__AFD63837
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaauaccacuauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagagccuuaugugucaugcgauccugacaaguguuaucaauuugcccuugggcagggaacaacacuaaacaacggacauucaaaugacacaguacaugauaggaccccuuaccggacccuauugaugaaugaauuggguguuccauuucauuugggaaccaggcaaguguguauagcaugguccagcucaaguugucacgauggaaaagcauggcugcauguuuguguaacuggggaugauaaaaaugcaacugcuaguuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucauucauauuagcacauugucaggaagugcucagcaugucgaggagugcuccuguuauccucgauauccuggugucagauguguaugccgagacaacuggaaaggcuccaauaggcccaucguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52242 - RNA, 1410 nt, Artificial Sequence
  neuraminidase__InfluenzaA__AFD63848
augaauccaaaucaaaagauaauaacaauuggcucuguuucucucaccauugccgcaauaugcuuccuuaugcaaauugccauccugguaacuacuguaacauugcauuucaagcagcgugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagagaaaacugaagucugguggaccucaaacaguauuguuguguuuuguggcaccucagguacauauggaacaggcucauggccugauggggcggauaucaaucucaugccuauauaa

SEQ ID NO: 52243 - RNA, 1410 nt, Artificial Sequence; identical to SEQ ID NO: 45956
  neuraminidase__InfluenzaA__AFD63859

SEQ ID NO: 52244 - RNA, 1410 nt, Artificial Sequence
  neuraminidase__InfluenzaA__AFD63870
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgacccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggaaugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52245 - RNA, 1410 nt, Artificial Sequence
  neuraminidase__InfluenzaA__AFD63881
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucuuaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52246 - RNA, 1410 nt, Artificial Sequence; identical to SEQ ID NO: 44729
  neuraminidase__InfluenzaA__AFD63892

SEQ ID NO: 52247 - RNA, 1410 nt, Artificial Sequence
  neuraminidase__InfluenzaA__AFD63903
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagggauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52248 - RNA, 1410 nt, Artificial Sequence
  neuraminidase__InfluenzaA__AFD63914
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagagaaaacugaagucugguggaccucaaacaguauuguuguguuuuguggcaccucagguacauauggaacaggcucauggccugauggggcggauaucaaucucaugccuauauaa

SEQ ID NO: 52249 - RNA, 1410 nt, Artificial Sequence
  neuraminidase__InfluenzaA__AFD63925
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaauaccacuauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagagccuuaugugucaugcgauccugacaaguguuaccaauuugcccuugggcagggaacaacacuaaacaacggacauucaaaugacacaguacaugauaggaccccuuaccggacccuauugaugaaugaauuggguguuccauuucauuugggaaccaggcaaguguguauagcaugguccagcucaaguugucacgauggaaaagcauggcugcauguuuguguaacuggggaugauaaaaaugcaacugcuaguuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucauucauauuagcacauugucaggaagugcucagcaugucgaggagugcuccuguuauccucgauauccuggugucagauguguaugccgagacaacuggaaaggcuccaauaggcccaucguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucuaaugccuauauaa

SEQ ID NO: 52250 - RNA, 1410 nt, Artificial Sequence
  neuraminidase__InfluenzaA__AFD63936
augaauccaaaucaaaagauaauaacaauuggcucuguuucucucaccauugccacaauaugcuuccuuaugcaaauugccauccugguaacuacuguaacauugcauuucaagcagcaugaaugcaacccccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugauaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuugcguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52251 - RNA, 1410 nt, Artificial Sequence; identical to SEQ ID NO: 45276
  neuraminidase__InfluenzaA__AFD63947

SEQ ID NO: 52252 - RNA, 1410 nt, Artificial Sequence
  neuraminidase__InfluenzaA__AFD63958
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuugcacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52253 - RNA, 1410 nt, Artificial Sequence; identical to SEQ ID NO: 45276
  neuraminidase__InfluenzaA__AFD63969

SEQ ID NO: 52254 - RNA, 1410 nt, Artificial Sequence; identical to SEQ ID NO: 45276
  neuraminidase__InfluenzaA__AFD63980

SEQ ID NO: 52255 - RNA, 1410 nt, Artificial Sequence
  neuraminidase__InfluenzaA__AFD64002
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaccgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaauugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52256 - RNA, 1410 nt, Artificial Sequence
  neuraminidase__InfluenzaA__AFD64013
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaauaacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguauuaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52257 - RNA, 1410 nt, Artificial Sequence
  neuraminidase__InfluenzaA__AFD64024
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaaaaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52258 - RNA, 1410 nt, Artificial Sequence
  neuraminidase__InfluenzaA__AFD64035
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggagaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguguuguuguguuuuguggcaccucagguacauauggaacaggcucauggccugauggggcggauaucaaucucaugccuauauaa

SEQ ID NO: 52259 - RNA, 1410 nt, Artificial Sequence
  neuraminidase__InfluenzaA__AFD64046
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgacccugacaaguguuaucaauuugcccucgggcagggaacaacacuaaacaacgggcauucaaaugacacaguacaugagaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaagauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagggggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52260 - RNA, 1410 nt, Artificial Sequence; identical to SEQ ID NO: 52241
  neuraminidase__InfluenzaA__AFD64057

SEQ ID NO: 52261 - RNA, 1410 nt, Artificial Sequence
  neuraminidase__InfluenzaA__AFD64068
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacauaauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52262 - RNA, 1410 nt, Artificial Sequence
  neuraminidase__InfluenzaA__AFD64079
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggauuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucaucgaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52263 - RNA, 1410 nt, Artificial Sequence; identical to SEQ ID NO: 45276
  neuraminidase__InfluenzaA__AFD64090

SEQ ID NO: 52264 - RNA, 1410 nt, Artificial Sequence
  neuraminidase__InfluenzaA__AFD64101
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugguaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucagaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52265 - RNA, 1410 nt, Artificial Sequence
  neuraminidase__InfluenzaA__AFD64112
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaauaccacuauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagagccuuaugugucaugcgauccugacaaguguuaucaauuugcccuugggcagggaacaacacuaaacaacggacauucaaaugacacaguacaugauaggaccccuuaccggacccuauugaugaaugaauuggguguuccauuucauuugggaaccaggcaaguguguauagcaugguccagcucaaguugucacgauggaaaagcauggcugcauguuuguguaacuggggaugauaaaaaugcaacugcuaguuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucauucauauuagcacauugucaggaagugcucagcaugucgaggagugcuccuguuauccucgauauccuggugucagauguguaugccgagacaacuggaaaggcuccaauaggcccaucguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagauaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52266 - RNA, 1410 nt, Artificial Sequence; identical to SEQ ID NO: 52226
  neuraminidase__InfluenzaA__AFD64123

SEQ ID NO: 52267 - RNA, 1410 nt, Artificial Sequence
  neuraminidase__InfluenzaA__AFD64134
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaacgacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52268 - RNA, 1410 nt, Artificial Sequence; identical to SEQ ID NO: 45276
  neuraminidase__InfluenzaA__AFD64145

SEQ ID NO: 52269 - RNA, 1410 nt, Artificial Sequence; identical to SEQ ID NO: 45276
  neuraminidase__InfluenzaA__AFD64156

SEQ ID NO: 52270 - RNA, 1410 nt, Artificial Sequence
  neuraminidase__InfluenzaA__AFD64167
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucuuaccaacaccaccauagagaaggaaauaugccccaaacuagcagaauacagaaauuggucaaagccgcaauguaacauuacaggauuugcaccuuuuucuaaggacaauucgauucggcuuucugcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52271 - RNA, 1410 nt, Artificial Sequence
  neuraminidase__InfluenzaA__AFD64181
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccucaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaauuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52272 - RNA, 1410 nt, Artificial Sequence
  neuraminidase__InfluenzaA__AFD64192
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauguuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52273 - RNA, 1410 nt, Artificial Sequence
  neuraminidase__InfluenzaA__AFD64203
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacaggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgcucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52274 - RNA, 1410 nt, Artificial Sequence
  neuraminidase__InfluenzaA__AFD64214
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaauaccacuauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagagccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuaguuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucauucauauuagcacauugucaggaagugcucagcaugucgaggagugcuccuguuauccucgauauccuggugucagauguguaugccgagacaacuggaaaggcuccaauaggcccaucguagauauaaauguaaaggauuauagcauuguuuccaguuaugugugcucaggacuuguuggagacacacccagaaaaaacgacagcuccagcaguagccauugccuagauccuaacaaugaggaagguggucauggagugaagggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52275 - RNA, 1410 nt, Artificial Sequence
  neuraminidase__InfluenzaA__AFD64225
augaauccaaaucaaaagauaauaacgauuggcucuguuucucucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggaccaagcaagugugcauagcaugguccagcucaaguugucacgauggaaaggcauggcugcauguuuguguaacgggggaugaugaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccuguuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccaaacaaugaggaagguggucauggagugaaaggcugggccuuugaugauggaaaugacguguggaugggaagaacgaucagcgagaaguuacgcucaggauaugaaaccuucaaagucauugaaggcugguccaacccuaacuccaaauugcagauaaauaggcaagucauaguugacagagguaauagguccgguuauucugguauuuucucuguugaaggcaaaagcugcaucaaucggugcuuuuauguggaguugauaaggggaagaaaacaagaaacugaagucuuguggaccucaaacaguauuguuguguuuuguggcaccucagguacauauggaacaggcucauggccugauggggcggacaucaaucucaugccuauauaa

SEQ ID NO: 52276 - RNA, 1410 nt, Artificial Sequence; identical to SEQ ID NO: 45276
  neuraminidase__InfluenzaA__AFD64317

SEQ ID NO: 52277 - RNA, 1410 nt, Artificial Sequence; identical to SEQ ID NO: 52226
  neuraminidase__InfluenzaA__AFD64328

SEQ ID NO: 52278 - RNA, 1410 nt, Artificial Sequence; identical to SEQ ID NO: 52234
  neuraminidase__InfluenzaA__AFD64339

SEQ ID NO: 52279 - RNA, 1410 nt, Artificial Sequence; identical to SEQ ID NO: 52236
  neuraminidase__InfluenzaA__AFD64350

SEQ ID NO: 52280 - RNA, 1410 nt, Artificial Sequence; identical to SEQ ID NO: 52234
  neuraminidase__InfluenzaA__AFD64361

SEQ ID NO: 52281 - RNA, 1410 nt, Artificial Sequence; identical to SEQ ID NO: 52241
  neuraminidase__InfluenzaA__AFD64372

SEQ ID NO: 52282 - RNA, 1410 nt, Artificial Sequence; identical to SEQ ID NO: 44729
  neuraminidase__InfluenzaA__AFD64383

SEQ ID NO: 52283 - RNA, 1410 nt, Artificial Sequence; identical to SEQ ID NO: 52249
  neuraminidase__InfluenzaA__AFD64394

SEQ ID NO: 52284 - RNA, 1410 nt, Artificial Sequence; identical to SEQ ID NO: 52252
  neuraminidase__InfluenzaA__AFD64405

SEQ ID NO: 52285 - RNA, 1410 nt, Artificial Sequence; identical to SEQ ID NO: 45276
  neuraminidase__InfluenzaA__AFD64416

SEQ ID NO: 52286 - RNA, 1410 nt, Artificial Sequence; identical to SEQ ID NO: 45276
  neuraminidase__InfluenzaA__AFD64427

SEQ ID NO: 52287 - RNA, 1410 nt, Artificial Sequence
  neuraminidase__InfluenzaA__AFD64438
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaccuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaacccaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52288 - RNA, 1410 nt, Artificial Sequence; identical to SEQ ID NO: 45276
  neuraminidase__InfluenzaA__AFD64449

SEQ ID NO: 52289 - RNA, 1410 nt, Artificial Sequence; identical to SEQ ID NO: 52270
  neuraminidase__InfluenzaA__AFD64460

SEQ ID NO: 52290 - RNA, 1410 nt, Artificial Sequence
  neuraminidase__InfluenzaA__AFD98098
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaaacaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauaguauuguuuccaguuauguguguucaggacuuguuggagacacacccagaaaaaacgacagcuccagcaguagccauuguuuggauccuaacaaugaggaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuauggaccucaaacaguauuguuguguuuuguggcaccucagguacauauggaacaggcucauggccugauggggcggaucucaaucucaugccuauauaa

SEQ ID NO: 52291 - RNA, 1410 nt, Artificial Sequence
  neuraminidase__InfluenzaA__AFD98120
augaauccaaaucaaaagauaauaacgauuggcucaguuucucucaccauuuccacaauaugcuucuucaugcaaauugccaucuugauaacuacuguaacauugcauuucaagcaauaugaauucaacucccccccaaacaaccaagugaugcugugugaaccgacaauaauagaaagaaacauaacagagauaguguaucugaccaacaccaccauagagaaggaaauaugccccaaacuagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcaagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauaguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuugggguaugaaaccuucaaagucauugaaggcugguccaacccuaaguccaaauugcagauaaauaggcaagucauaguugacaaagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 52292 - RNA, 1410 nt, Artificial Sequence
  neuraminidase__InfluenzaA__AFD98131
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcagaccucaaucucaugccuauauaa

SEQ ID NO: 52293 - RNA, 1410 nt, Artificial Sequence; identical to SEQ ID NO: 52290
  neuraminidase__InfluenzaA__AFD98142

SEQ ID NO: 52294 - RNA, 1410 nt, Artificial Sequence; identical to SEQ ID NO: 52291
  neuraminidase__InfluenzaA__AFD98164

SEQ ID NO: 52295 - RNA, 1410 nt, Artificial Sequence
  neuraminidase__InfluenzaA__AFD98175
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccgacaauaauagaaagaaacauaacagagauaguguaucugaccaacaccaccauagagaaggaaauaugccccaaacuagcagaauacagaaauuggucaaaaccgcaaugugacauuacaggauuugcaccuuuuucuaaggacaauucgauuaggcuuuccgcugguggagacaucugggugacaagagaaccuuaugugucaugcgauccugacaaguguuaucaauuugcccuuggacagggaacaacacuaaacaacgugcauucaaauaacacaguacaugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcaagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauaguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuugggguaugaaaccuucaaagucauugaaggcugguccaacccuaaguccaaauugcagauaaauaggcaagucauaguugacaaagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 52296 - RNA, 1410 nt, Artificial Sequence
  neuraminidase__InfluenzaA__AFD98186
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaaguuugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucguugaggaggggaaaaucguucauacuagcacauugucaggaagugcucagcaugucgaggagugcucuugcuauccucgauauccuggugucagaugugucugcagagacaacuggaaaggcuccaauaggcccauaguagauauaaacauaaaggaucauagcauuauuuccaguuauguauguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaggaggaaacugaagucuuguggaccucaaacaguauuguuguguuuuguggcaccucagguacauauggaacaggcucauggccugauggggcggaccucaaucucaugccuauauaa

SEQ ID NO: 52297 - RNA, 1410 nt, Artificial Sequence
  neuraminidase__InfluenzaA__AFD98197
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaagcugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagggaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 52298 - RNA, 1410 nt, Artificial Sequence; identical to SEQ ID NO: 50759
  neuraminidase__InfluenzaA__AFD98208

SEQ ID NO: 52299 - RNA, 1410 nt, Artificial Sequence
  neuraminidase__InfluenzaA__AFD98218
augaauccaaaucaaaagauaauaacgauuggcucuguuucucucaccauuuccacaauaugcuucuucaugcaaauugccaucuugauaacuacugugacauugcauuucaagcaauaugaauucaacucccccccaaacaaccaagugaugcugugugaaccgacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcaagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauaguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucgacgagacgucacgcuugggguaugaaaccuucaaagucauugaaggcugguccaacccuaaguccaaauugcagauaaauaggcaagucauaguugacaaagguaauagguccgguuauucugguauuuucucuguugaaggcaaaagcugcaucaaucggugcuuuuauguggaguugauuaggggaagaaaagaggaaacugaagucuuguggaccucaaacaguauuguugugucuuguggcaccucagguacauauggaacaggcucauggccugauggggcggaccucaaucucaugccuauauaa

SEQ ID NO: 52300 - RNA, 1410 nt, Artificial Sequence
  neuraminidase__InfluenzaA__AFD98229
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaaguaugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaagauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 52301 - RNA, 1410 nt, Artificial Sequence
  neuraminidase__InfluenzaA__AFD98240
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuagacuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggaugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 52302 - RNA, 1410 nt, Artificial Sequence
  neuraminidase__InfluenzaA__AFD98251
augaauccaaaucaaaagauaauaacgauuggcucaguuucucucaccauuuccacaauaugcuucuucaugcaaauugccaucuugauaacuacuguaacauugcauuucaagcaauaugaauucaacucccccccaaacaaccaagugaugcugugugaaccgacaauaauagaaagaaacauaacagagauaguguaucugaccaacaccaccauagagaaggaaauaugccccaaacuagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgaugggaaagcauggcugcauguuuguauaacgggggaugauaaaaaugcaacugcaagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauaguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuugggguaugaaaccuucaaagucauugaaggcugguccaacccuaaguccaaauugcagauaaauaggcaagucauaguugacaaagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 52303 - RNA, 1410 nt, Artificial Sequence
  neuraminidase__InfluenzaA__AFD98262
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccgacaauaauagaaagaaacauaacagagauaguguaucugaccaacaccaccauagagaaggaaauaugccccaaacuagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcaagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauaguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuugggguaugaaaccuucaaagucauugaaggcugguccaacccuaaguccaaauugcagauaaauaggcaagucauaguugacaaagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 52304 - RNA, 1410 nt, Artificial Sequence
  neuraminidase__InfluenzaA__AFD98273
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcugucccauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggacuguauuagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52305 - RNA, 1410 nt, Artificial Sequence
  neuraminidase__InfluenzaA__AFD98283
augaauccaaaccaaaagauaauaaccauugguucggucuguaugacaauuggaauggcuaacuuaauauuacaaauuggaaacauaaucucaauauggauuagccacucaauucaacuugggaaucaaagccagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacuggaacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaauacaaucuggacuagcgggagcagcauauccuuuugugguguaaacagugacacuguggguuggucuuggccagacggugcugaguugccauuuaccauugacaaguaa

SEQ ID NO: 52306 - RNA, 1410 nt, Artificial Sequence
  neuraminidase__InfluenzaA__AFD98293
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugccagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaaugacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 52307 - RNA, 1410 nt, Artificial Sequence; identical to SEQ ID NO: 51329
  neuraminidase__InfluenzaA__AFD98313

SEQ ID NO: 52308 - RNA, 1410 nt, Artificial Sequence
  neuraminidase__InfluenzaA__AFD98323
augaauccaaaccaaaagauaauaaccauugguucggucuguaugacaauuggaauggcuaacuuaauauuacaaauuggaaacauaaucucaauauggauuagccacucaauucaacuugggaaucaaagucaaauugaaacaugcaaucaaagcgucauuacuuaugaaaacaacacuuggguaaaucagacauauguuaacaucagcaacaccaacuuugcugcuggacagucaguuguuuccgugaaauuagcgggcaauuccucucucugcccuguuaguggaugggcuauauacaguaaagacaacaguauaagaaucgguuccaagggggauguguuugucauaagggaaccauucauaucaugcuccccauuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuagcucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52309 - RNA, 1410 nt, Artificial Sequence; identical to SEQ ID NO: 51329
  neuraminidase__InfluenzaA__AFD98333

SEQ ID NO: 52310 - RNA, 1410 nt, Artificial Sequence; identical to SEQ ID NO: 52291
  neuraminidase__InfluenzaA__AFD98343

SEQ ID NO: 52311 - RNA, 1410 nt, Artificial Sequence
  neuraminidase__InfluenzaA__AFD98354
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccgacaauaauagaaagaaacauaacagagauaguguaucugaccaacaccaccauagagaaggaaauaugccccaaacuagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaggugugcauagcaugguccagcucaaguugucacgauggaaaagcauggcugcauguuuguauaacgggggaugauaaaaaugcaacugcaagcuucauuuacaaugggaggcuuguagauaguguuguuucaugguccaaagaaauucucaggacccaggagucagaaugcguuuguaucaauggaacuuguacaguaguaaugacugauggaaaugcuucaggaaaagcugauacuaaaauacuauucauugaggaggggaaaaucguucauacuagcacauuguuaggaagugcucagcaugucgaggagugcucuugcuauccucgauauccuggugucagaugugucugcagagacaacuggaaaggcuccaauaggcccaucguagauauaaacauaaaggaucauagcauaguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuugggguaugaaaccuucaaagucauugaaggcugguccaacccuaaguccaaauugcagauaaauaggcaagucauaguugacaaagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 52312 - RNA, 1410 nt, Artificial Sequence
  neuraminidase__InfluenzaA__AFD98365
augaacccaaaucaaaagauaauaacgauuggcucuguuucucucaccauuuccacaauaugcuucuucaugcaaauugccaucuugauaacuacuguaacauugcauuucaagcaauaugaauucuacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccugggacagggaacaacacuaaacaacgugcauucaaauaacacaguacgugauaggaccccuuauaggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguugauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacuaaagucuuguggaccucaaacaguauuguuguguuuuguggcaccucagguacauauggaacaggcucauggccugauggggcggaccucaaucucaugccuauauaa

SEQ ID NO: 52313 - RNA, 1410 nt, Artificial Sequence
  neuraminidase__InfluenzaA__AFD98376
augaauccaaaucaaaagauaauaacgauuggcucuguuucucucaccauuuccacaauaugcuucuucaugcaaauugccaucuugauaacuacuguaacauugcauuucaagcaauaugaauucaacuuccccccaaacaaccaagugaugcugugugaaccgacaauaauagaaagaaacauaacagagauaguguaucugaccaacaccaccauagagaaggaaauaugccccaaacuagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcaagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauaguuuccaguuauguguguucaggacuuguuggagacacacccagaaaaaacgacagcuccagcaguggccauuguuuggauccuaacaaugaagaagguggucauggagugaaaggcugggccuuugaugauggaaaugacguguggaugggaagaacaaucaacgagacgucacgcuugggguaugaaaccuucaaagucauugaaggcugguccaacccuaaguccaaauugcagauaaauaggcaagucauaguugacaaagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 52314 - RNA, 1410 nt, Artificial Sequence
  neuraminidase__InfluenzaA__AFD98387
augaauccaaaucaaaagauaauaacgauuggcucuguuucucucaccauuuccacaauaugcuucuuaaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagagauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacaaggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaagcuuguagauaguguugucucaugguccaaagaaauccucaggacccaggagucagaaugcguuuguaucaaugggacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagauccagcaauagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 52315 - RNA, 1410 nt, Artificial Sequence
  neuraminidase__InfluenzaA__AFD98398
augaauccaaaucaaaagauaauaacgauuggcucaguuucucucaccauuuccacaauaugcuucuucaugcaaauugccaucuugauaacuacuguaacauugcauuucaagcaauaugaauucaacucccccccaaacaaccaagugaugcugugugaaccgacaauaauagaaagaaacauaacagagauaguguaucugaccaacaccaccauagagaaggaaauaugccccaaacuagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaggcaagugugcauagcaugguccagcucaaguugucacgaugggaaagcauggcugcauguuuguauaacgggggaugauaaaaaugcaacugcaagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauaguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuugggguaugaaaccuucaaagucauugaaggcugguccaacccuaaguccaaauugcagauaaauaggcaagucauaguugacaaagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 52316 - RNA, 1410 nt, Artificial Sequence
  neuraminidase__InfluenzaA__AFD98409
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccgacaauaauagaaagaaacauaacagagauaguguaucugaccaacaccaccauagagaaggaaauaugccccaaacuagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcaagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauaguuuccaguuauguguguucaggacuuguuggagacacacccagaaaaaacgacagcuccagcaguggccauuguuuggauccuaacaaugaagaagguggucauggagugaaaggcugggccuuugaugauggaaaugacguguggaugggaagaacaaucaacgagacgucacgcuugggguaugaaaccuucaaagucauugaaggcugguccaacccuaaguccaaauugcagauaaauaggcaagucauaguugacaaagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 52317 - RNA, 1410 nt, Artificial Sequence; identical to SEQ ID NO: 52291
  neuraminidase__InfluenzaA__AFD98420

SEQ ID NO: 52318 - RNA, 1410 nt, Artificial Sequence
  neuraminidase__InfluenzaA__AFD98431
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguuggcagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 52319 - RNA, 1410 nt, Artificial Sequence
  neuraminidase__InfluenzaA__AFD98442
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcugucccauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuggugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucgcaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52320 - RNA, 1410 nt, Artificial Sequence
  neuraminidase__InfluenzaA__AFD98452
augaacccaaaucaaaagauaauaacgcuuggcucuguuucucucaccauuuccacaauaugcuucuucauacaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaacucgauuaggcuuuccgcugguggggacaucugggugacaagagaaccuuaugugucaugcgaucccgacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguggauaguguuguuucaugguccaaagaaauccucaggacccaagagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauaucccggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcagcagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 52321 - RNA, 1410 nt, Artificial Sequence
  neuraminidase__InfluenzaA__AFD98463
augaauccaaaucaaaagauaauaacgauuggcucuguuucucucacuauuuccacaauaugcuucuucaugcaaauugccaucuugauaacuacuguaacauugcauuucaagcaauaugaauucaacucccccccaaacaaccaagugaugcugugugaaccgacaauaauagaaagaaacauaacagagauaguguaucugaccaacaccaccauagagaaggaaauaugccccaaacuagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcaagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauaguuuccaguuauguguguucagggcuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuugggguaugaaaccuucaaagucauugaaggcugguccaacccuaaguccaaauugcagauaaauaggcaagucauaguugacaaagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 52322 - RNA, 1410 nt, Artificial Sequence
  neuraminidase__InfluenzaA__AFD98474
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaacuuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugaaaugauuugggauccaaacggauggacugggacagacaauaacuucucaauaaagcaagauaucauaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52323 - RNA, 1410 nt, Artificial Sequence
  neuraminidase__InfluenzaA__AFD98484
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagaugaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 52324 - RNA, 1410 nt, Artificial Sequence
  neuraminidase__InfluenzaA__AFD98495
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaaacaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcuaauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauaguauuguuuccaguuauguguguucaggacuuguuggagacacacccagaaaaaacgacagcuccagcaguagccauuguuuggauccuaacaaugaggaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcuguaucaaucggugcuuuuauguggaguugauuaggggaagaaaagaggaaacugaagucuuauggaccucaaacaguauuguuguguuuuguggcaccucagguacauauggaacaggcucauggccugauggggcggaucucaaucucaugccuauauaa

SEQ ID NO: 52325 - RNA, 1410 nt, Artificial Sequence
  neuraminidase__InfluenzaA__AFD98506
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccgacaauaauagaaagaaacauaacagagauaguguaucugaccaacaccaccauagagaaggaaauaugccccaaacuagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcaagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcauguugaggagugcucuugcuauccucgauauccuggugucagaugugucugcagagacaacuggaaaggcuccaauaggcccaucguagauauaaacauaaaggaucauagcauaguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuugggguaugaaaccuucaaagucauugaaggcugguccaacccuaaguccaaauugcagauaaauaggcaagucauaguugacaaagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 52326 - RNA, 1410 nt, Artificial Sequence
  neuraminidase__InfluenzaA__AFD98517
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaaacaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauuaaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaggaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuauggaccucaaacaguauuguuguguuuuguggcaccucagguacauauggaacaggcucauggccugauggggcggaccucaaucucaugccuauauaa

SEQ ID NO: 52327 - RNA, 1410 nt, Artificial Sequence
  neuraminidase__InfluenzaA__AFD98528
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccagcuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 52328 - RNA, 1410 nt, Artificial Sequence; identical to SEQ ID NO: 52303
  neuraminidase__InfluenzaA__AFD98539

SEQ ID NO: 52329 - RNA, 1410 nt, Artificial Sequence
  neuraminidase__InfluenzaA__AFD98550
augaauccaaaucaaaagauaauaacgauuggcucuguuucucuaaccauuuccacaauaugcuucuucaugcaaauugccaucuugauaacuacuguaacauugcauuucaagcaauaugaauucaacucccccccaaacaaccaagugaugcugugugaaccgacaauaauagaaagaaacauaacagagauaguguaucugaccaacaccaccauagagaaggaaauaugccccaaacuagcagaauacagaaauuggucaaaaccgcaaugugacauuacaggauuugcaccuuuuucuaaggacaauucgauuaggcuuuccgcugguggagacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcaagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauaguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuugggguaugaaaccuucaaagucauugaaggcugguccaacccuaaguccaaauugcagauaaauaggcaagucauaguugacaaagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 52330 - RNA, 1410 nt, Artificial Sequence
  neuraminidase__InfluenzaA__AFD98561
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggacccccuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuugugcaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaagcgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 52331 - RNA, 1410 nt, Artificial Sequence
  neuraminidase__InfluenzaA__AFD98572
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccuuagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggagaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugauagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 52332 - RNA, 1410 nt, Artificial Sequence
  neuraminidase__InfluenzaA__AFD98583
augaauccaaaucaaaagauaauaacgauuggcucuguuucucucaccauuuccacaauaugcuucuucaugcaaauugccaucuugauaaccaccguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuagggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggacccccuaucggacccuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaagcgacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 52333 - RNA, 1410 nt, Artificial Sequence
  neuraminidase__InfluenzaA__AFE02944
augaauccaaaccaaaagauaauaaccauugguucggucuguaugacaauuggaauggcuaacuuaauauuacaaauuggaaacauaaucucaauauggauuagucacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaucagaaucuggaauaucagauaggauacauaugcagugggauuuucggagacaauccacgcccuaaugauaagacaggcaguugugguccaguaucgucuaauggagcaaaugggguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcugaauuguauaagaccuugcuucuggguugaacuaaucagagggcgacccaaagagaacacagucuggacuagcgggagcagcauauccuuuugugguguaaacagugacacuguggguuggucuuggccggacggugcugaguugccauuuaccauugacaaguaa

SEQ ID NO: 52334 - RNA, 1410 nt, Artificial Sequence
  neuraminidase__InfluenzaA__AFE47627
augaauccaaaucaaaagauaauaacgauuggcucuguuucucucaccauugccacaauaugcuuccuuaugcaaauugccauccugguaacuacuguaacguugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguaucgguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgguauccuggugucagaugugucugcagagacaauuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagacaaauaggcaagucauaguugacagagguaauagguccgguuauucugguauuuucucuguugaaagcaaaagcugcaucaauaggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 52335 - RNA, 1410 nt, Artificial Sequence
  neuraminidase__InfluenzaA__AFF18509
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaaacaagugugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauaguauuguuucuaguuauguguguucaggacuuguuggagacacacccagaaaaaacgacagcuccagcaguagccauuguuuggauccuaacaaugaggaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuauggaccucaaacaguauuguuguguuuuguggcaccucagguacauauggaacaggcucauggccugauggggcggaucucaaucucaugccuauauaa

SEQ ID NO: 52336 - RNA, 1410 nt, Artificial Sequence
  neuraminidase__InfluenzaA__AFF57129
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggagauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguugaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggaaugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52337 - RNA, 1410 nt, Artificial Sequence
  neuraminidase__InfluenzaA__AFF57133
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuugguuaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccucggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52338 - RNA, 1410 nt, Artificial Sequence
  neuraminidase__InfluenzaA__AFF57137
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggaauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52339 - RNA, 1410 nt, Artificial Sequence; identical to SEQ ID NO: 52338
  neuraminidase__InfluenzaA__AFF57141

SEQ ID NO: 52340 - RNA, 1410 nt, Artificial Sequence; identical to SEQ ID NO: 52338
  neuraminidase__InfluenzaA__AFF57145

SEQ ID NO: 52341 - RNA, 1410 nt, Artificial Sequence; identical to SEQ ID NO: 52338
  neuraminidase__InfluenzaA__AFF57149

SEQ ID NO: 52342 - RNA, 1410 nt, Artificial Sequence; identical to SEQ ID NO: 52338
  neuraminidase__InfluenzaA__AFF57153

SEQ ID NO: 52343 - RNA, 1410 nt, Artificial Sequence
  neuraminidase__InfluenzaA__AFF57157
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggaauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucaguugaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52344 - RNA, 1410 nt, Artificial Sequence; identical to SEQ ID NO: 52343
  neuraminidase__InfluenzaA__AFF57161

SEQ ID NO: 52345 - RNA, 1410 nt, Artificial Sequence; identical to SEQ ID NO: 52338
  neuraminidase__InfluenzaA__AFF57165

SEQ ID NO: 52346 - RNA, 1410 nt, Artificial Sequence; identical to SEQ ID NO: 52338
  neuraminidase__InfluenzaA__AFF57169

SEQ ID NO: 52347 - RNA, 1410 nt, Artificial Sequence; identical to SEQ ID NO: 52338
  neuraminidase__InfluenzaA__AFF57173

SEQ ID NO: 52348 - RNA, 1410 nt, Artificial Sequence; identical to SEQ ID NO: 52338
  neuraminidase__InfluenzaA__AFF57177

SEQ ID NO: 52349 - RNA, 1410 nt, Artificial Sequence; identical to SEQ ID NO: 52338
  neuraminidase__InfluenzaA__AFF57181

SEQ ID NO: 52350 - RNA, 1410 nt, Artificial Sequence; identical to SEQ ID NO: 52338
  neuraminidase__InfluenzaA__AFF57185

SEQ ID NO: 52351 - RNA, 1410 nt, Artificial Sequence
  neuraminidase__InfluenzaA__AFF57189
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuagaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggaauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52352 - RNA, 1350 nt, Artificial Sequence
  neuraminidase__InfluenzaA__AFF60789
augaauccaaauaagaagauaauaaccaucggaucaaucuguaugguaacuggaaugguuagcuuaauguuacaaauugggaacuugaucucaauaugggucagucauucaauucacacagggaaucaacacaaagcugaaccaaucagcaauacuaauuuucuuacugagaaagcuguggcuucaguaaaauuagcgggcaauucaucucuuugccccauuaauggaugggcuguauacaguaaggacaacaguauaaggaucgguuccaagggggauguguuuguuauaagagagccauucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaauaacauacugagaacucaagagucugaaugugcauguguaaauggcucuugcuuuacuguaaugacugacggaccaaguaauggucaggcaucacauaagaucuucaaaauggaaaaagggaaagugguuaaaucagucgaauuggaugcucccaauuaucacuaugaggaaugcuccuguuauccugaugccggcgaaaucacaugugugugcagggauaauuggcauggcucaaaucggccauggguaucuuucaaucaaaauuuggaguaucaaauaggauauauaugcaguggaguuuucggagacaauccacgccccaaugauggaacagguaguugugguccgguguccucuaacggggcauaugggguaaaaggguuuucauuuaaauacggcaauggugucuggaucgggagaacaaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaacuagugacacuguggguuggucuuggccagacggugcugaauugccauucaccauugacaaguag

SEQ ID NO: 52353 - RNA, 1410 nt, Artificial Sequence
  neuraminidase__InfluenzaA__AFG29043
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacauaagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuagagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacgguauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugaucugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52354 - RNA, 1410 nt, Artificial Sequence
  neuraminidase__InfluenzaA__AFG29045
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggaaaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugcccccaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52355 - RNA, 1410 nt, Artificial Sequence
  neuraminidase__InfluenzaA__AFG31063
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcaucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52356 - RNA, 1410 nt, Artificial Sequence; identical to SEQ ID NO: 47242
  neuraminidase__InfluenzaA__AFG31073

SEQ ID NO: 52357 - RNA, 1410 nt, Artificial Sequence
  neuraminidase__InfluenzaA__AFG31083
augaauccaaaccaaaagauaauaaccauugguucggucuguaugacaauuggaauggcuaacuuaauauuacaaauuggaaacauaaucucaauauggauuagccacucaauucaacuugugaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaggagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagaaaacacaaucuggacuagcgggagcagcauaucuuuuugugguguaaacagugacacuguggguuggucuuggccagacggugcugaguugccauuuaccauugacaaguaa

SEQ ID NO: 52358 - RNA, 1410 nt, Artificial Sequence
  neuraminidase__InfluenzaA__AFG31093
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuagaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52359 - RNA, 1410 nt, Artificial Sequence; identical to SEQ ID NO: 52358
  neuraminidase__InfluenzaA__AFG31103

SEQ ID NO: 52360 - RNA, 1410 nt, Artificial Sequence; identical to SEQ ID NO: 47242
  neuraminidase__InfluenzaA__AFG31113

SEQ ID NO: 52361 - RNA, 1410 nt, Artificial Sequence
  neuraminidase__InfluenzaA__AFG31123
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacgugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52362 - RNA, 1410 nt, Artificial Sequence; identical to SEQ ID NO: 52361
  neuraminidase__InfluenzaA__AFG31133

SEQ ID NO: 52363 - RNA, 1410 nt, Artificial Sequence; identical to SEQ ID NO: 52361
  neuraminidase__InfluenzaA__AFG31143

SEQ ID NO: 52364 - RNA, 1410 nt, Artificial Sequence; identical to SEQ ID NO: 48505
  neuraminidase__InfluenzaA__AFG31153

SEQ ID NO: 52365 - RNA, 1410 nt, Artificial Sequence; identical to SEQ ID NO: 48505
  neuraminidase__InfluenzaA__AFG31163

SEQ ID NO: 52366 - RNA, 1410 nt, Artificial Sequence
  neuraminidase__InfluenzaA__AFG31173
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcuacccaaagagaacacaaucuggacuagcgggagcagcauauccuuuugugguguaaacagugacacuguggguuggucuuggccagacggugcugaguugccauuuaccauugacaaguaa

SEQ ID NO: 52367 - RNA, 1410 nt, Artificial Sequence; identical to SEQ ID NO: 52366
  neuraminidase__InfluenzaA__AFG31183

SEQ ID NO: 52368 - RNA, 1410 nt, Artificial Sequence; identical to SEQ ID NO: 47242
  neuraminidase__InfluenzaA__AFG31193

SEQ ID NO: 52369 - RNA, 1410 nt, Artificial Sequence; identical to SEQ ID NO: 47242
  neuraminidase__InfluenzaA__AFG31203

SEQ ID NO: 52370 - RNA, 1410 nt, Artificial Sequence; identical to SEQ ID NO: 47242
  neuraminidase__InfluenzaA__AFG31213

SEQ ID NO: 52371 - RNA, 1410 nt, Artificial Sequence; identical to SEQ ID NO: 47242
  neuraminidase__InfluenzaA__AFG31223

SEQ ID NO: 52372 - RNA, 1410 nt, Artificial Sequence; identical to SEQ ID NO: 47242
  neuraminidase__InfluenzaA__AFG31233

SEQ ID NO: 52373 - RNA, 1410 nt, Artificial Sequence
  neuraminidase__InfluenzaA__AFG31243
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuuguugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52374 - RNA, 1410 nt, Artificial Sequence
  neuraminidase__InfluenzaA__AFG31253
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaaugacuucucaauaaagcaagauaucguaggaauaaaugaguggucaggauauagcgggaguuuuguucagcauccagaacuaacagggcuggauuguauaagaccuugcuucuggguugaauuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52375 - RNA, 1410 nt, Artificial Sequence; identical to SEQ ID NO: 47242
  neuraminidase__InfluenzaA__AFG31263

SEQ ID NO: 52376 - RNA, 1410 nt, Artificial Sequence; identical to SEQ ID NO: 47242
  neuraminidase__InfluenzaA__AFG31273

SEQ ID NO: 52377 - RNA, 1410 nt, Artificial Sequence; identical to SEQ ID NO: 47242
  neuraminidase__InfluenzaA__AFG31283

SEQ ID NO: 52378 - RNA, 1410 nt, Artificial Sequence; identical to SEQ ID NO: 47242
  neuraminidase__InfluenzaA__AFG31293

SEQ ID NO: 52379 - RNA, 1410 nt, Artificial Sequence; identical to SEQ ID NO: 47242
  neuraminidase__InfluenzaA__AFG31303

SEQ ID NO: 52380 - RNA, 1410 nt, Artificial Sequence; identical to SEQ ID NO: 47242
  neuraminidase__InfluenzaA__AFG31313

SEQ ID NO: 52381 - RNA, 1410 nt, Artificial Sequence; identical to SEQ ID NO: 47242
  neuraminidase__InfluenzaA__AFG31326

SEQ ID NO: 52382 - RNA, 1410 nt, Artificial Sequence; identical to SEQ ID NO: 47242
  neuraminidase__InfluenzaA__AFG31336

SEQ ID NO: 52383 - RNA, 1410 nt, Artificial Sequence; identical to SEQ ID NO: 52374
  neuraminidase__InfluenzaA__AFG31346

SEQ ID NO: 52384 - RNA, 1410 nt, Artificial Sequence; identical to SEQ ID NO: 52374
  neuraminidase__InfluenzaA__AFG31356

SEQ ID NO: 52385 - RNA, 1410 nt, Artificial Sequence; identical to SEQ ID NO: 52374
  neuraminidase__InfluenzaA__AFG31366

SEQ ID NO: 52386 - RNA, 1410 nt, Artificial Sequence; identical to SEQ ID NO: 52374
  neuraminidase__InfluenzaA__AFG31379

SEQ ID NO: 52387 - RNA, 1410 nt, Artificial Sequence; identical to SEQ ID NO: 52374
  neuraminidase__InfluenzaA__AFG31389

SEQ ID NO: 52388 - RNA, 1410 nt, Artificial Sequence; identical to SEQ ID NO: 52374
  neuraminidase__InfluenzaA__AFG31399

SEQ ID NO: 52389 - RNA, 1410 nt, Artificial Sequence; identical to SEQ ID NO: 52374
  neuraminidase__InfluenzaA__AFG31409

SEQ ID NO: 52390 - RNA, 1410 nt, Artificial Sequence; identical to SEQ ID NO: 47242
  neuraminidase__InfluenzaA__AFG31419

SEQ ID NO: 52391 - RNA, 1410 nt, Artificial Sequence; identical to SEQ ID NO: 47242
  neuraminidase__InfluenzaA__AFG31429

SEQ ID NO: 52392 - RNA, 1410 nt, Artificial Sequence; identical to SEQ ID NO: 47242
  neuraminidase__InfluenzaA__AFG31439

SEQ ID NO: 52393 - RNA, 1410 nt, Artificial Sequence; identical to SEQ ID NO: 47242
  neuraminidase__InfluenzaA__AFG31449

SEQ ID NO: 52394 - RNA, 1410 nt, Artificial Sequence; identical to SEQ ID NO: 47242
  neuraminidase__InfluenzaA__AFG31459

SEQ ID NO: 52395 - RNA, 1410 nt, Artificial Sequence; identical to SEQ ID NO: 47242
  neuraminidase__InfluenzaA__AFG31469

SEQ ID NO: 52396 - RNA, 1410 nt, Artificial Sequence; identical to SEQ ID NO: 47242
  neuraminidase__InfluenzaA__AFG31479

SEQ ID NO: 52397 - RNA, 1410 nt, Artificial Sequence; identical to SEQ ID NO: 47242
  neuraminidase__InfluenzaA__AFG31499

SEQ ID NO: 52398 - RNA, 1410 nt, Artificial Sequence; identical to SEQ ID NO: 49198
  neuraminidase__InfluenzaA__AFG31509

SEQ ID NO: 52399 - RNA, 1410 nt, Artificial Sequence; identical to SEQ ID NO: 52374
  neuraminidase__InfluenzaA__AFG31519

SEQ ID NO: 52400 - RNA, 1410 nt, Artificial Sequence
  neuraminidase__InfluenzaA__AFG31529
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaccaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaaaggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52401 - RNA, 1410 nt, Artificial Sequence
  neuraminidase__InfluenzaA__AFG31539
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcugaacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaaaauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52402 - RNA, 1410 nt, Artificial Sequence; identical to SEQ ID NO: 47242
  neuraminidase__InfluenzaA__AFG31549

SEQ ID NO: 52403 - RNA, 1410 nt, Artificial Sequence; identical to SEQ ID NO: 47242
  neuraminidase__InfluenzaA__AFG31559

SEQ ID NO: 52404 - RNA, 1410 nt, Artificial Sequence
  neuraminidase__InfluenzaA__AFG31569
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaagccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaaugacuucucaauaaagcaagauaucguaggaauaaaugaguggucaggauauagcgggaguuuuguucagcauccagaacuaacagggcuggauuguauaagaccuugcuucuggguugaauuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52405 - RNA, 1410 nt, Artificial Sequence; identical to SEQ ID NO: 47242
  neuraminidase__InfluenzaA__AFG31579

SEQ ID NO: 52406 - RNA, 1410 nt, Artificial Sequence; identical to SEQ ID NO: 47242
  neuraminidase__InfluenzaA__AFG31589

SEQ ID NO: 52407 - RNA, 1410 nt, Artificial Sequence; identical to SEQ ID NO: 47242
  neuraminidase__InfluenzaA__AFG31599

SEQ ID NO: 52408 - RNA, 1410 nt, Artificial Sequence; identical to SEQ ID NO: 47242
  neuraminidase__InfluenzaA__AFG31609

SEQ ID NO: 52409 - RNA, 1410 nt, Artificial Sequence; identical to SEQ ID NO: 47242
  neuraminidase__InfluenzaA__AFG31619

SEQ ID NO: 52410 - RNA, 1410 nt, Artificial Sequence; identical to SEQ ID NO: 47242
  neuraminidase__InfluenzaA__AFG31629

SEQ ID NO: 52411 - RNA, 1410 nt, Artificial Sequence; identical to SEQ ID NO: 52374
  neuraminidase__InfluenzaA__AFG31639

SEQ ID NO: 52412 - RNA, 1410 nt, Artificial Sequence
  neuraminidase__InfluenzaA__AFG31649
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggaaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52413 - RNA, 1410 nt, Artificial Sequence; identical to SEQ ID NO: 47242
  neuraminidase__InfluenzaA__AFG31659

SEQ ID NO: 52414 - RNA, 1410 nt, Artificial Sequence; identical to SEQ ID NO: 47242
  neuraminidase__InfluenzaA__AFG31669

SEQ ID NO: 52415 - RNA, 1410 nt, Artificial Sequence; identical to SEQ ID NO: 44599
  neuraminidase__InfluenzaA__AFG71868

SEQ ID NO: 52416 - RNA, 1410 nt, Artificial Sequence; identical to SEQ ID NO: 44599
  neuraminidase__InfluenzaA__AFG71890

SEQ ID NO: 52417 - RNA, 1410 nt, Artificial Sequence
  neuraminidase__InfluenzaA__AFG71901
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgaucauggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagagugugguggacuucaaacaguauuguuguguuuuguggcacuucagguaccuauggaacaggcucauggccugauggggcgaacaucaauuucaugccuauauaa

SEQ ID NO: 52418 - RNA, 1410 nt, Artificial Sequence; identical to SEQ ID NO: 44618
  neuraminidase__InfluenzaA__AFG71912

SEQ ID NO: 52419 - RNA, 1410 nt, Artificial Sequence
  neuraminidase__InfluenzaA__AFG71934
augaauccaaaucaaaagauaauaacaauuggcucugucucucucaccauugcaacaguaugcuuccucaugcagauugccauccugauaacuacuguaacauugcauuucaagcaauaugagugcgacucccccgcgaacaaccaaguaaugccgugugaaccaauaauaauagaaaggaacauaacagagauaguguauuugacuaacaccaccauagagaaagagauaugccccaaauuaguggaauacagaaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacccuagacaacaaacauucaaaugacacaauacaugauagaaucccucaucgaacccuauugaugaaugaguuggguguuccauuucauuuaggaaccaggcaaguguguauagcaugguccagcucaaguugucacgauggaaaagcauggcugcauguuugugucacuggggaugauaaaaaugcaacugcuagcuucauuuacgaugggaggcuuguggacaguauugguucauggucucaaaauauccucaggacccaggagucggaaugcguuuguaucaaugggacuuguacuguaguaaugacugauggaagugcuucaggaagagcugauacuagaauacuauucauugaagaggggaaaauuguccauauuagcccauugucaggaagugcucagcauguagaggaguguuccuguuauccucgauauccuggcgucagauguaucugcagagacaacuggaaaggcucuaauaggcccgucguagauauaaaugugaaagauuauagcauugauucccguuaugugugcucagggcuuguuggcgacacacccagaaacaacgacagauuuagcaauagcaauugcaggaauccuaacaaugagagagggaaucacggagugaaaggcugggccuuugacgauggaaaugacguguggaugggaagaacgaucagcaaggauucacgcucagguuaugaaaccuucaaagucauuggugguugguccacaccuaauuccaaaucgcagauaaauaggcaagucauaguugacagcgauaauaggucagguuauucugguauuuucucaguugagggcaaaagcugcaucaauaggugcuuuuauguggaguugauaaggggaagggaacaggagacuagaguaugguggaccucaaacaguauuguuguguuuuguggcacuucagguaccuaugggacaggcucauggccugauggggcggacaucaaucucaugccuauauaa

SEQ ID NO: 52420 - RNA, 1410 nt, Artificial Sequence
  neuraminidase__InfluenzaA__AFG71945
augaauccaaaucaaaagauaauaacaauuggcucugucucucucaccauugcaacaguaugcuuccucaugcagauugccauccugguaacuacuguaacauugcauuucaagcaauaugagugcgacucccccgcgaacaaccaaguaaugccgugugaaccaauaauaauagaaaggaacauaacagagauaguguauuugacuaacaccaccauagagaaagagauaugccccaaauuaguggaauacagaaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauugaugaaugaguuggguguuccauuucauuuaggaaccaggcaaguguguauagcaugguccagcucaaguugucacgauggaaaagcauggcugcauguuugugucacuggggaugaugaaaaugcaacugcuagcuucauuuacgaugggaggcuuguggacaguauugguucauggucucaaaauauccucaggacccaggagucggaaugcguuuguaucaaugggacuuguacaguaguaaugacugauggaagugcuucaggaagagcugauacuagaauacuauucauugaagaggggaaaauuguccauauuagcccauugucaggaagugcucagcauguagaggaguguuccuguuauccucgauauccuggcgucagauguaucugcagagacaacuggaaaggcucuaauaggcccgucguagauauaaaugugaaagauuauagcauugauucccguuaugugugcucagggcuuguuggcgacacacccagaaacaaugacaaaucuagcaauagcaauugcaggaauccuaacaaugauaaagggaaucauggagugaaaggcugggccuuugacgauggaaaugacguguggaugggaagaacgaucagcaaggauucacgcucagguuaugaaaccuucaaagucauuggugguugguccacaccuaauuccaaaucgcagauaaauaggcaagucauaguugacagcgauaauaggucagguuacucugguauuuucucuguugagggcaaaagcugcaucaauagaugcuuuuacguggaguugauaaggggaagggaacaggagacuaaaguaugguggaccucaaacaguauuguuguguuuuguggcacuucagguaccuaugggacaggcucauggccugauggggcggacaucaaucucaugucuauauaa

SEQ ID NO: 52421 - RNA, 1410 nt, Artificial Sequence; identical to SEQ ID NO: 44837
  neuraminidase__InfluenzaA__AFG71967

SEQ ID NO: 52422 - RNA, 1410 nt, Artificial Sequence; identical to SEQ ID NO: 50632
  neuraminidase__InfluenzaA__AFG71978

SEQ ID NO: 52423 - RNA, 1410 nt, Artificial Sequence
  neuraminidase__InfluenzaA__AFG71988
augaauccaaaucaaaagauaauaacaauuggcucugucucucucaccauugcaacaauaugcuuccucaugcagauugccauccugguaacuacuguaacauugcauuucaagcaauaugagugcgacucccccgcgaacaaccaaguaaugccgugugaaccaauaauaauagaaaggaacauaacagagauaguguauuugacuaacaccaccauagagaaagagauaugccccaaauuaguggaauacaggaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaccccucaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucauggucucaaaauauccucaggacccaggagucggaaugcauuuguaucaaugggacuuguacaguaguaaugacugauggaagugcuucaggaagagcugauacuaaaauacuauucauugaagaggggaaaauuguucauauuagcccauugucaggaagugcucagcauguagaggaguguuccuguuauccucgauauccuggugucagauguaucugcagagacaacuggaaaggcucuaauaggcccgucguagauauaaaugugaaagauuauagcauugauuccaguuaugugugcucagggcuuguuggcgacacacccagaaacaacgacagaucuagcaauagcuauugcaggaauccuaacaaugagaaagggaaucacggagugaaaggcugggccuuugacgauggaaaugacguguggaugggaagaacgaucagcgaggauucacgcucagguuaugaaaccuucaaagucauuggugguugguccacaccuaauuccaaauugcagauaaauaggcaagucauaguugacagcgauaauaggucagguuauucugguauuuucucuguugagggcaaaagcugcaucaauaggugcuuuuauguggaguugauaaggggaagggaacaggaaacuagaguaugguggaccucaaacaguauuguuguguuuuguggcacuucagguaccuaugggacaggcucauggccugauggggcggacaucaaucucaugccuauauaa

SEQ ID NO: 52424 - RNA, 1410 nt, Artificial Sequence
  neuraminidase__InfluenzaA__AFG71999
augaauccaaaucaaaagauaauaacaauuggcucugucucucucaccauugcaacaauaugcuuccucaugcagauugccauccugguaacuacuguaacauugcauuucaagcaauaugagugcgacucccccgcgaacaaccaaguaaugccgugugaaccaauaauaauagaaaggaacauaacagaaauaguguauuugacuaacaccaccauagaaaaagagauaugucccaaauuaguggaauacaggaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaccccucaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucauggucucaaaauauccucaggacccaggaaucggaaugcguuuguaucaaugggacuuguacaguaguaaugacugauggaagugcuucaggaagagcugauacuaaaauacuauucauugaagaggggaaaauuguucauauuagcccauugucaggaagugcucagcauguagaggaguguuccuguuauccucgauauccuggugucagauguaucugcagagacaacuggaaaggcucuaauaggcccgucguagauauaaaugugaaagauuauagcauugauuccaguuaugugugcucagggcuuguuggcgacacacccagaaacaacgacagaucuagcaauagcuauugccggaauccuaacaaugagaaagggaaucacggagugaaaggcugggccuuugacgauggaaaugacguguggaugggaagaacgaucagcgaggauucacgcucagguuaugaaaccuucaaagucauuggugguugguccacaccuaauuccaaauugcagauaaauaggcaagucauaguugacagcgauaauaggucagguuauucugguauuuucucuguugagggcaaaagcugcaucaauaggugcuuuuauguggaguugauaaggggaagggaacaggaaacuagaguaugguggacuucaaacaguauuguuguguuuuguggcacuucagguaccuaugggacaggcucauggccugauggggcggacaucaaucucaugccuauauaa

SEQ ID NO: 52425 - RNA, 1410 nt, Artificial Sequence; identical to SEQ ID NO: 45080
  neuraminidase__InfluenzaA__AFG72021

SEQ ID NO: 52426 - RNA, 1410 nt, Artificial Sequence
  neuraminidase__InfluenzaA__AFG72032
augaauccaaaucaaaagauaauaacaauuggcucugucucucucaccauugcaacaauaugcuuccuuaugcaaauugccauccugguaacuacuguaacauugcauuucaagcaauaugagugcagcucccccccaaacaaccaaguaaugccgugugaaccaauaauaauagaaagaaacauaacagagauaguguauuugacuaacaccaccauagagaaagagauaugccccaaauuaguggaauacagaaauuggucaaaaccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaagcauucaaaugacacaauacaugauaggaccccuuaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaauuguucauauuagcccauugucaggaagugcucagcauguagaggaguguuccuguuauccucgauauccuggugucagaugugucugcagagacaacuggaaaggcuccaauaggcccgucguagauauaaaugugaaagauuauagcauuguuuccaguuaugugugcucagggcuuguuggcgacacacccagaaaaaacgacagaucuagcaguagcuauugccggaauccuaacaaugagaaagggaaucauggagugaaaggcugggccuuugacgauggaaaugacguguggaugggaagaacgaucagcgaggagucacgcucagguuaugaaaccuucaaagucauuggugguugguccacaccuaauuccaaauugcagauaaauaggcaagucauaguugacagcgauaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcacuucagguaccuauggaacaggcucauggccugauggagcggacaucaaucucaugccuauauaa

SEQ ID NO: 52427 - RNA, 1410 nt, Artificial Sequence
  neuraminidase__InfluenzaA__AFG72088
augaauccaaaucaaaagauaauaacaauuggcucuguuucucucaccauugccacaauaugcuuucuuaugcaaauugccauccugguaacuacuguaacauugcauuucaagcaauaugagugcagcucccccccaaacaaccaaguaaugccgugugaaccaacaauaauagaaagaaauauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuugggcagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagauccagcaguagcuauugccggaauccuaacaaugagaaagggagucauggagugaaaggcugggccuuugacgauggaaaugacguguggaugggaagaacgaucggcgaggaguuacguucagguuaugaaaccuucaaagucauuggagguugguccacaccuaacuccaaauugcagauaaauaggcaagucauaguugacagcgguaauagguccgguuauucugguauuuucucuguugagggcaaaagcugcaucaaucggugcuuuuauguggaguugauaaggggaagggaacaggaaacuagagucugguggaccucaaacaguauuguuguguuuuguggcaccucagguacauauggaacaggcucauggccugauggggcggacaucaaucucaugccuauauaa

SEQ ID NO: 52428 - RNA, 1410 nt, Artificial Sequence
  neuraminidase__InfluenzaA__AFG72121
augaauccaaaucaaaagauaauaacaauuggcucuguuucucucaccauugccacaauaugcuuccuuaugcaaauugccauccugguaacuacuguaacauugcauuucaagcaauaugagugcagcucccccccaaacaaccgaguaaugccgugcgaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuugggcagggaaccacacuaaacaacaggcauucaaaugacacaguacaugauaggaccccuuaucgaacccucuugaugaaugaguuggguguuccauuucauuugggaaccaagcaagugugcauggcaugguccagcucaagcugucacgauggaaaagcauggcugcauguuugugucacugggcaugaugaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagauccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggagguugguccacaccuaacuccaaauugcagauaaauaggcaagucauaguugacagcgguaauagguccgguuauucugguauuuucucuguugagggcaaaagcugcaucaaucggugcuuuuauguggaguugauaaggggaaggaaacaggaaacuagagucugguggaccucaaacaguauuguuguguuuuguggcaccucagguacauauggaacaggcucauggccugauggggcggacaucaaucucaugccuauauaa

SEQ ID NO: 52429 - RNA, 1410 nt, Artificial Sequence
  neuraminidase__InfluenzaA__AFG72143
augaauccaaaucaaaagauaauaacaauuggcucuguuucucucaccauugccacaauaugccuccuuaugcaaauugccauccugguaacuacuguaacauugcauuucaagcaauacgagugcagcucccccccaaacaaccaaguaaugccgugugaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggaggcuuguagauaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguaguuauugccggaauccuaacaaugagaaagggagucauggagugaaaggcugggccuuugacgauggaaaugacguguggaugggaagaacgaucggcgaggaguuacgcucagguuaugaaaccuucaaagucauuggagguugguccacaccuaacuccaaauugcagauaaauaggcaagucauaguugacagcgguaauagguccgguuauucugguauuuucucuguugagggcaaaagcugcaucaaucggugcuuuuauguggaguugauaaggggaaggaaacaggaaacuaaagucugguggaccucaaacaguauuguuguguuuuguggcaccucagguacauauggaacaggcucauggccugauggggcggacaucaaucucaugccuauauaa

SEQ ID NO: 52430 - RNA, 1410 nt, Artificial Sequence
  neuraminidase__InfluenzaA__AFG72165
augaauccaaaucaaaagauaauaacaauuggcucuguuucucucaccauugccacaauaugcuuccuuaugcaaauugccauccugguaacuacuguaacauugcauuucaagcaauaugagugcaacucccccccaaacaaccaaguaaugccgugugaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuaggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggaggcuuguagauaguauuguuucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccggaauccuaacaaugagaaagggagucauggaguaaaaggcugggccuuugacgauggaaaugacguguggaugggaagaacgaucggcgaggaguuacgcucagguuaugaaaccuucaaagucauuggaggcugguccacaccuaacuccaaauugcagacaaauaggcaagucauaguugacagagguaauagguccgguuauucugguauuuucucuguugaaggcaaaagcugcaucaaucggugcuuuuauguagaauugauaaggggaaggaaacaggaaacuaaagucugguggaccucaaacaguauuguuguguuuuguggcaccucagguacauauggaacaggcucauggccugauggggcggacaucaaucucaugccuauauaa

SEQ ID NO: 52431 - RNA, 1410 nt, Artificial Sequence
  neuraminidase__InfluenzaA__AFG72176
augaauccaaaucaaaagauaauaacaauuggcucuguuucucucacuauugccacaauaugcuuccuuaugcaaauuaccauccugguaacuacuguaacauugcauuucaagcaauaugagugcaacucccccccaaacaaccaaguaaugcugugugaaccaacaauaauagaaagaaacauaacagagauaguguauuugacuaacaccaccauagagaaagagaaaugccccaaacuaguagaauacagaaauuggucaaagccgcaauguaaaaucacaggauuugcaccuuuuucuaaggacaauucaauucggcuuuccgcugguggagacauuugggugacaagagaaccuuaugugucaugcgauccuggcaaguguuaucaauuugcacuuggacagggaaccacacuaaacaacaggcauucaaaugacacaguacaugauaggaccccuuaucgaacccucuugaugaaugaguuggguguuccauuucauuugggaaccaagcaagugugcauagcaugguccaguucaaguugucacgauggaaaagcauggcugcauguuugugucacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauacccuggugucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccggaauccuaacaaugagaaaggaagucauggagugaaaggcugggccuuugacgauggaaaugacguguggaugggaagaacgaucagcgaggaguuacgcucagguuaugaaaccuucaaagucauuggaggcugguccacaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaaauaaagucugguggaccucaaacaguauuguuguguuuuguggcaccucagguacauauggaacaggcucauggccugauggggcggacaucaaucucaugccuauauaa

SEQ ID NO: 52432 - RNA, 1410 nt, Artificial Sequence
  neuraminidase__InfluenzaA__AFG72198
augaauccaaaucaaaagauaauaacaauuggcucuguuucucucaccauugccacaauaugcuuccuuaugcaaauugccauccugguaacuacuguaacauugcauuucaagcaauaugagugcaacucccccccaaacaaccaaguaaugccgugugaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuaggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggaggcuuguagauaguauuguuucaugguccaaaaauauccucaggacccaggagucagaaugcguuuguaucaauggaacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccggaauccuaacaaugaaaaagggagucauggagugaaaggcugggccuuugacgauggaaaugacguguggaugggaagaacgaucggcgaggaguuacgcucagguuaugaaaccuucaaagucauuggaggcugguccacaccuaacuccaaauugcagacaaauaggcaagucauaguugacagagguaauagguccgguuauucugguauuuucucuguugaaggcaaaagcugcaucaaucggugcuuuuauguagaauugauaaggggaaggaaacaggaaacuaaagucugguggaccucaaacaguauuguuguguuuuguggcacaucagguacauauggaacaggcucauggccugauggggcggacaucaaucucaugccuauauaa

SEQ ID NO: 52433 - RNA, 1410 nt, Artificial Sequence
  neuraminidase__InfluenzaA__AFG72209
augaauccaaaucaaaagauaauaacaauuggcucuguuucucucaccauugccacaauaugcuuccuuaugcaaauugccauccugguaacuacuguaacauugcauuucaagcaauaugagugcaacucccccccaaacaaccaaguaaugccgugugaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuaggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuaguuucauuuacgaugggaggcuuguagauaguauuguuucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccggaauccuaacaaugagaaagggagucauggaguaaaaggcugggccuuugacgauggaaaugacguguggaugggaagaacgaucggcgaggaguuacgcucagguuaugaaaccuucaaagucauuggaggcugguccacaccuaacuccaaauugcagacaaauaggcaagucauaguugacagagguaauagguccgguuauucugguauuuucucuguugaaggcaaaagcugcaucaaucggugcuuuuauguagaauugauaaggggaaggaaacaggaaacuaaagucugguggaccucaaacaguauuguuguguuuuguggcaccucagguacauauggaacaggcucauggccugauggggcggacaucaaucucaugccuauauaa

SEQ ID NO: 52434 - RNA, 1410 nt, Artificial Sequence
  neuraminidase__InfluenzaA__AFG72220
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauagugcaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52435 - RNA, 1410 nt, Artificial Sequence
  neuraminidase__InfluenzaA__AFG72231
augaauccaaaucaaaagauaauaacaauuggcucuguuucucucaccauugccacaauaugcuuccuuaugcaaauugccauccugguaacuacuguaacauugcauuucaagcaauaugagugcaacucccccccaaacaaccaaguaaugccgugugaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuaggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggaggcuuguagauaguauuguuucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggaggcugguccacaccuaacuccaaauugcagacaaauaggcaagucauaguugacagagguaauagguccgguuauucugguauuuucucuguugaaggcaaaagcugcaucaaucggugcuuuuauguagaauugauaaggggaaggaaacaggaaacuaaagucugguggaccucaaacaguauuguuguguuuuguggcacaucagguacauauggaacaggcucauggccugauggggcggacaucaaucucaugccuauauaa

SEQ ID NO: 52436 - RNA, 1410 nt, Artificial Sequence
  neuraminidase__InfluenzaA__AFG72297
augaauccaaaucaaaagauaauaacaauuggcucuguuucucuaacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguauuugacuaacaccaccauagagagagaaauaugccccaaacuggcagaauacagaaauuggucaaagccgcaauguaaaauuacaggguuugcaccuuuuucuaaagacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugagaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaagaaaacaggaaacugaagucugguggaccucaaacaguauuguuguguuuuguggcaccucagguacauauggaacaggcucauggccugauggggcggacaucaaucucaugccuauauaa

SEQ ID NO: 52437 - RNA, 1410 nt, Artificial Sequence
  neuraminidase__InfluenzaA__AFG72308
augaauccaaaucaaaagauaauaacaauuggcucuguuucucucacuauugccacaauaugcuuccuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaagguugggccuuugaugauggaaaugacguguggaugggaagaacgaucagcgaggaguuacgcucugguuaugaaaccuucagaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52438 - RNA, 1410 nt, Artificial Sequence
  neuraminidase__InfluenzaA__AFG72320
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcacucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52439 - RNA, 1410 nt, Artificial Sequence
  neuraminidase__InfluenzaA__AFG72331
augaauccaaaucaaaagauaauaacaauuggcucuguuucucucacuguugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcacucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52440 - RNA, 1410 nt, Artificial Sequence
  neuraminidase__InfluenzaA__AFG72353
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauucuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuugcaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugagggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52441 - RNA, 1410 nt, Artificial Sequence; identical to SEQ ID NO: 52438
  neuraminidase__InfluenzaA__AFG72364

SEQ ID NO: 52442 - RNA, 1410 nt, Artificial Sequence
  neuraminidase__InfluenzaA__AFG72430
augaauccaaaucaaaagauaauaacaauuggcucuguuucucucacuauuaccacaauaugcuuccuuaugcaaauugccauccugguaauuacuguaacauugcauuucaagcaaugugaaugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaacucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcauaaugaaaaugcaacugcgagcuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagccaauugucaggaagugcucagcaugucgaggagugcuccuguuauccucgauauccuggugucagaugugucugcagagacaacuggaaaggcucuaauaggcccaucguagauauaaaugugaaagauuauagcauuguuuccaguuauguaugcucaggacuuguuggagacacaccccgaaaaaacgacagcuccagcaguagcaauugccuggauccuaacaaugaggaagggggucauggagugaaaggcugggccuuugaugauggaaaugauguguggaugggaagaacgaucagcgagaaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52443 - RNA, 1410 nt, Artificial Sequence
  neuraminidase__InfluenzaA__AFG72452
augaauccaaaucaaaagauaauaacaauuggcucuguuucucucacuauugccacaauaugcuuccuuaugcaaauugccauccugguaacuacugugacauugcauuucaagcaauaugagugcaacucccccccaaacaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggaaaguguuaucaauuugcacuuggacagggaacaacacuaaacaacaggcauucaaaugacacaguacaugauaggaccccuuaucgaacccuauugaugaaugaguugggugucccauuucauuugggaaccaagcaggugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagauguguuugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52444 - RNA, 1410 nt, Artificial Sequence
  neuraminidase__InfluenzaA__AFG72474
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguauuugacuaacaccaccauagagaaagaaauaugccccaaacuggcagaauacagaaauuggucaaagccgcaaugugaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52445 - RNA, 1410 nt, Artificial Sequence
  neuraminidase__InfluenzaA__AFG72485
augaauccaaaucaaaagauaauaacaauuggcucuguuucucucacuauugccacaauaugcuuccuuaugcaaauugccauccugguaacuacuguaacauugcauuucaagcaacaugagugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52446 - RNA, 1410 nt, Artificial Sequence
  neuraminidase__InfluenzaA__AFG72507
augaauccaaaucaaaagauaauaacaauuggcucuguuucucucacuauugccacaauaugcuuccuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaauuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52447 - RNA, 1410 nt, Artificial Sequence
  neuraminidase__InfluenzaA__AFG72529
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcacucaaaugacacaguacaugauaggaccccuuaucgaacccuauugaugaaugaguuggguguuccauuucauuugggaaccaaacaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgguauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuacugccaaaauccuaacaaugagaaugggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52448 - RNA, 1410 nt, Artificial Sequence
  neuraminidase__InfluenzaA__AFG72540
augaauccaaaucaaaagauaauaacaauuggcucuguuucucucacuauugccacaauaugcuuccuuaugcaaauugccauccugguaacuacuguaacauugcauuucaagcaauaugagugcaacccccccccaaacaaccaaguaaugcugugugaaccaacaauaauagaaagaaacauaacagagauaguguaucugaccaacaccaccauaaagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugcuggaauccuaacaaugagaaagggggucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52449 - RNA, 1410 nt, Artificial Sequence
  neuraminidase__InfluenzaA__AFG72562
augaauccaaaucaaaagauaauaacaauuggcucuguuucucucacuauugccacaauaugcuuccuuaugcaaauugccauccuuguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugcuggaauccuaacaaugagaaaggggggcauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguauuuuguggcaccucagguacauauggaacaggcucauggccugauggggcggacaucaaucucaugccuauauaa

SEQ ID NO: 52450 - RNA, 1410 nt, Artificial Sequence
  neuraminidase__InfluenzaA__AFG72584
augaauccaaaucaaaagauaauaacaauuggcucuguuucucucacuauugccacaauaugcuuccuuaugcagauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaguaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaagcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaaaagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugcuggaauccuaacaaugagaaagggggucauggagugaaaggcugggccuuugaugauggaaaugacguguggaugggaagaacgaucagcgaggaguuacgcucagguuaugaaaccuucaaagucauuggaggcugguccaaaccuaauuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52451 - RNA, 1410 nt, Artificial Sequence
  neuraminidase__InfluenzaA__AFG72606
augaauccaaaucaaaagauaauaacaauuggcucuguuucucucacuauugccacaauaugcuuccuuaugcaaauugccauccugguaacuacuguaacauugcauuucaagcaauaugaaugcaacucccccccaaacaaccaaguaaugcuaugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacagugguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagaucauagcauuguuuccaguuaugugugcucaggacuuguuggagacacacccagaaaaaacgacagcuccagcaguagcuauugccugaauccuaacaaugaggaagggggucauggagugaaaggcugggccuuugaugauggaaaugacguguggaugggaagaacgaucagcgagaaguuacgcucagguuaugaaaccuucaaggucauuggaggcugguccaaaccuaacuccaaauugcagauaaauaggcaagucauaguugacagagguaauagguccgguuauucugguauuuucucuguugaaggcaaaagcugcgucaaucggugcuuuuauguggaguugauaaggggaaggaaacaggaaacugaagucugguggaccucaaacaguauuguuguguuuugcggcaccucagguacauauggaacaggcucauggccugauggggcggacauaaaucucaugccuauauaa

SEQ ID NO: 52452 - RNA, 1410 nt, Artificial Sequence
  neuraminidase__InfluenzaA__AFG72617
augaauccaaaucaaaagauaauaacaauuggcucuguuucucucacuauuaccacaauaugcuuccuuaugcaaauugccauccuaguaauuacuguaacauugcauuucaagcaaugugaaugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcauaaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccugaauccuaacaaugaggaagggggucauggagugaaaggcugggccuuugaugauggaaaugauguguggaugggaagaacgaucagcgagaaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52453 - RNA, 1410 nt, Artificial Sequence
  neuraminidase__InfluenzaA__AFG72628
augaauccaaaucaaaagauaauaacuauuggcucuguuucucucacuauugccacaauaugcuuccuuaugcaaauugccauccugguaacuacuguaacauuacauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugauggaagugcuucaggaagagcugauacuaaaauacuauucauugaagaggggaaaaucguucauauuagcccauugucaggaagugcucagcaugucgaggagugcuccuguuauccucgauauucuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52454 - RNA, 1410 nt, Artificial Sequence
  neuraminidase__InfluenzaA__AFG72639
augaauccaaaucaaaagauaauaacaauuggcucuguuucucucacuauugccacaauaugcuuccuuaugcaaauugccauccugguaacuacuguaacauuacauuucaagcaauaugaaugcaacucccccccaaacaaccaaguaaugcugugugaaccaacaauaauagagagaaacauaacagagauaguguaucugaccaacaccaccauagagaaagaaauaugccccaaacuagcagaauacagaaauuggucaaagccgcaauguaaaauuacaggauuugcaccuuuuuccaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuugcaucaauggaacuuguacaguaguaaugacugauggaagugcuucaggaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccugaauccuaacaaugaggaagggggucauggagugaaaggcugggccuuugaugauggaaaugauguguggaugggaagaacgaucagcgagaaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52455 - RNA, 1410 nt, Artificial Sequence
  neuraminidase__InfluenzaA__AFG72650
augaauccaaaucaaaagauaauaacaauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacagugcaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccugaauccuaacaaugaggaagggggucauggagugaaaggcugggccuuugaugauggaaaugacguguggaugggaagaacgaucagcgagaaguuacgcucagguuaugaaaccuucaaggucauuggaggcugguccaaaccuaacuccaaauugcagauaaauaggcaagucauaguugacagagguaauagguccgguuauucugguauuuucucuguugaaggcaaaagcugcgucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52456 - RNA, 1410 nt, Artificial Sequence
  neuraminidase__InfluenzaA__AFG72672
augaauccaaaucaaaagauaauaacuauuggcucuguuucucucacuauugccacaauaugcuuccuuaugcaaauugccauccugguaacuacuguaacauuacauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugauggaagugcuucaggaagagcugauacuaaaauacuauucauugaagaggggaaaaucguucauauuagcccauugucaggaagugcucagcaugucgaggagugcuccuguuauccucgauauucuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaguuacgcucagguuaugaaaccuucaaagucauuggaggcugguccaaaccuaacuccaaauugcagauaaauagacaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52457 - RNA, 1407 nt, Artificial Sequence
  neuraminidase__InfluenzaA__AFG72683
augaauccaaaucaaaagauaauaacaauuggcucuguuucucucacuauugccacaauaugcuuccuuaugcaaauugccauccugguaauuacuguaacauugcauuucaagcaauaugaaugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugaaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcauaaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauaucagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugauguguggaugggaagaacgaucagcgagaaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52458 - RNA, 1410 nt, Artificial Sequence
  neuraminidase__InfluenzaA__AFG72705
augaauccaaaucaaaagauaauaacgauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucaaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauauuagccaauugucaggaagugcucagcaugucgaggagugcuccuguuauccucgauauccuggugucagaugugucugcagagacaacuggaaaggcuccaauaggcccaucguagauauaaauguaaaggaucauagcauuguuuccaguuaugugugcucaggacuuguuggagacacacccagaaaaaacgacagcuccagcaguagccauugccugaauccuaacaaugaagaagggggucauggagugaaaggcugggccuuugaugauggaaaugacguguggaugggaagaacgaucagcgagaaguuacgaucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaaguaugguggaccucaaacaguauuguuguguuuuguggcaccucagguacauauggaacaggcucauggccugauggggcggacaucaaucucaugccuauauaa

SEQ ID NO: 52459 - RNA, 1410 nt, Artificial Sequence
  neuraminidase__InfluenzaA__AFG72716
augaauccaaaucaaaagauaauaacaauuggcucuguuucucucacuauuaccacaauaugcuuccuuaugcaaauugccauccugguaauuacuguaacauugcauuucaagcaaugugaaugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacuggacauaaugaaaaugcaacugcgagcuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccuggauccuaacaaugaggaagggggucauggagugaaaggcugggccuuugaugauggaaaugauguguggaugggaagaacgaucagcgagaagucacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggagacaggaaacugaagucugguggaccucaaacaguauuguuguguuuuguggcaccucagguacauauggaacaggcucauggccugauggggcggacaucaaucucaugccuauauaa

SEQ ID NO: 52460 - RNA, 1410 nt, Artificial Sequence
  neuraminidase__InfluenzaA__AFG72738
augaauccaaaucaaaagauaauaacaauuggcucuguuucucucacuauuaccacaauaugcuuccuuaugcaaauugccauccugguaauuacuguaacauugcauuucaagcaaugugaaugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaacucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcauaaugaaaaugcaacugcgagcuucaucuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagccaauugucaggaagugcucagcaugucgaggagugcuccuguuauccucgauauccuggugucagaugugucugcagagacaacuggaaaggcucuaauaggcccaucguagauauaaaugugaaagauuauagcauuguuuccaguuauguaugcucaggacuuguuggagacacacccagaaaaaacgacagcuccagcaguagcuauugccuggauccuaacaaugaggaagggggucauggagugaaaggcugggccuuugaugauggaaaugauguguggaugggaagaacgaucagcgagaaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52461 - RNA, 1410 nt, Artificial Sequence
  neuraminidase__InfluenzaA__AFG72749
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52462 - RNA, 1410 nt, Artificial Sequence; identical to SEQ ID NO: 47217
  neuraminidase__InfluenzaA__AFG72760

SEQ ID NO: 52463 - RNA, 1410 nt, Artificial Sequence; identical to SEQ ID NO: 44563
  neuraminidase__InfluenzaA__AFG72771

SEQ ID NO: 52464 - RNA, 1410 nt, Artificial Sequence
  neuraminidase__InfluenzaA__AFG72782
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcacgaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauacuagccaauugucaggaagugcucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaauuccgcucagguuaugaaaccuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52465 - RNA, 1410 nt, Artificial Sequence
  neuraminidase__InfluenzaA__AFG72793
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcccauugucaggaagugcucagcaugucgaggaaugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaacccaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 52466 - RNA, 1410 nt, Artificial Sequence; identical to SEQ ID NO: 46975
  neuraminidase__InfluenzaA__AFG72804

SEQ ID NO: 52467 - RNA, 1410 nt, Artificial Sequence; identical to SEQ ID NO: 52275
  neuraminidase__InfluenzaA__AFG72826

SEQ ID NO: 52468 - RNA, 1410 nt, Artificial Sequence
  neuraminidase__InfluenzaA__AFG72837
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugagaggaccccuuaccggacccuauugaugaaugaguuggguguuccauuucauuugggaaccaagcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucaggacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggauggggagaacgaucagcgagaaguuacgcucagguuaugaaaccuucaaagucaucgagggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52469 - RNA, 1413 nt, Artificial Sequence
  neuraminidase__InfluenzaA__AFG72848
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaauaccacuauagagaaggaaauaugccccaaaucagcagaauacagaaauuggucaaagccgcaauguaacauuacaggauuugcaccuuuuucuaaggacaauucgauucggcuuuccgcugguggggacaucugggugacaagagagccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuaguuucauuuacaaugggaggcuuguagauaguauugguucaugguccaaaaaauauauacucagaacccaggagucggaaugcguuuguaucaauggaacuuguacaguaguaaugacugaugggagcgcuucaggaaaagcugauacuaaaauacuauucauugaggaggggaaaaucauucauauuagcacauugucaggaagugcucagcaugucgaggagugcuccuguuauccucgauauccuggugucagauguguaugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52470 - RNA, 1410 nt, Artificial Sequence
  neuraminidase__InfluenzaA__AFG72859
augaauccaaaucaaaagauaauaacgauuggcucuguuucucucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgccgguggggacaucugggugacaagagaaccuuaugugucaugcgauccugacaaguguuaucaauuugcccuuggacagggaacaacacuaaacaacgugcauucaaaugacauaguacaugauaggaccccuuaucggacccuauugaugaaugaguuggguguuccauuucaucuggggaccaagcaagugugcauagcaugguccagcucaaguugucacgauggaaaagcauggcugcauguuuguguaacgggggaugaugaaaaugcaacugcuagcuucauuuacaaugggagacuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaguguuccuguuauccucgauauccuggugucagaugugucugcagagacaauuggaaaggcuccaauaggcccaucguagauauaaacauaaaggauuauagcauuguuuccaguuaugugugcucaggacuuguuggagacacacccagaaaaaacgacagcuccagcaguagccauugcuuggauccaaacaaugaggaagguggucauggagugaaaggcugggccuuugaugauggaaaugacguguggaugggaagaacgaucagcgagaaguuacgcucaggauacgaaaccuucaaagucauugaaggcugguccaacccuaacuccaaauugcagauaaauaggcaagucauaguugacagagguaauagguccgguuauucugguauuuucucuguugaaggcaaaagcugcaucaaucggugcuuuuauguggaguugauaagaggaagaaaacaggaaacugaagucuuguggaccucaaacaguauuguuguguuuuguggcaccucagguacauauggaacaggcucauggccugauggggcggacaucaaucucaugccuauauaa

SEQ ID NO: 52471 - RNA, 1410 nt, Artificial Sequence
  neuraminidase__InfluenzaA__AFG72870
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaauaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacaucacaggauuugcaccuuuuucuaaggacaauucgauucggcuuuccgcugguggggacaucugggugacaagagaaccuuaugugucaugcgauccugacaaguguuaucaauuugcacuuggacagggaacaacacuaaacaacgggcauucaaaugacacaguacaugauaggaccccuuaccggacccuauugaugaaugaguuggguguuccauuucauuugggaaccaagcaagugugcauagcaugguccagcucaaguugucacgauggaaaagcauggcugcauguuuguguaacuggagaugaugaaaaugcaacugcuagcuucauuuacaaugggaggcuuguagauaguauugguucaugguccaaaaaaauacucaggacccaggagucggaaugcguuuguaucaauggaacuuguacaguaguaaugacugaugggagcacuucaggaaaagcugauacuaaaauacuauucauugaggaggggaaaaucguucauauuagcacauugucaggaagugcucagcauguagaggagugcuccuguuauccucgauauccuggugucagaugugucugcagggacaacuggaaaggcuccaauaggcccaucguagauauaaauguaaaggauuauagcauuguuuccaguuaugugugcucaggacuuguuggagacacacccagaaaaaaugacagcuucagcaguagccauugccuagauccuaacaaugaggaagguggucauggagugaagggcugggccuuugaugauggaaaugacguuuggaugggaagaacgaucagcgagaaguuacgcucagguuaugaaaccuucaaagucaucgaaggcugguccaaaccuaacuccaaauugcagauaaauaggcaagucauaguugaaagaggaaacagguccgguuauucugguauuuucuccguugaaagcaaaagcugcaucaaucggugcuuuuauguggaguugauaaggggaaggaaagaggaaacugaagucugguggaccucaaacaguauuguuguguuuuguggcacuucagguacauauggaacaggcucauggccugauggggcggauaucaaucucaugccuauauaa

SEQ ID NO: 52472 - RNA, 1410 nt, Artificial Sequence
  neuraminidase__InfluenzaA__AFG72892
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagagaaaacugaagucuuguggaccucaaacaguauuguuguguuuuguggcaccucagguacauauggaacaggcucauggccugauggggcggacaucaaucucaugccuauauaa

SEQ ID NO: 52473 - RNA, 1410 nt, Artificial Sequence
  neuraminidase__InfluenzaA__AFG72903
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuacugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauaguauuguuuccaguuaugugugcucaggacuuguuggagacacacccagaaaaaaagauagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagaggugauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52474 - RNA, 1410 nt, Artificial Sequence
  neuraminidase__InfluenzaA__AFG72936
augaauccaaaucaaaagauaauaacgauuggcucuguuucucucaccauuuccacaauaugcuucuucauacaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacauaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcgucuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaaccauaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 52475 - RNA, 1410 nt, Artificial Sequence
  neuraminidase__InfluenzaA__AFG72958
augaacccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgccgguggggacaucugggugacaagagaaccuuaugugucaugcgauccugacaaguguuaucaauuugcccuuggacagggaacaacacuaaacaacgugcauucaaauaacauaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaagagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 52476 - RNA, 1410 nt, Artificial Sequence
  neuraminidase__InfluenzaA__AFG98811
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugauaaaaaugcaacugcuagcuucauuuaugacgggaggcuuguggacaguauugguucauggucucaaaauauccucagaacccaggagucagaaugcguuuguaucaaugggaccugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagaguaugguggaccucaaacaguauuguuguguuuuguggcacuucagguaccuauggaacaggcucauggccugauggggcgaacaucaauuucaugccuauauaa

SEQ ID NO: 52477 - RNA, 1410 nt, Artificial Sequence
  neuraminidase__InfluenzaA__AFG98822
augaauccaaaucaaaagauaauaacaauuggcucugucucucucaucauugcaacaguaugcuuccucaugcagauugccauccugguaacuacuguaacauugcauuuuaaacaacaugagugcgacucccccucgagcaaccaaguaaugcugugugaaccaauaauaauagaaaggaacauaacagagauaguguauuugaauaacaccaccauagagaaagagacaugccccaaauuaguggaauacagaaauuggucaaagccgcaauguaaaauuacaggauuugcaccuuuuucuaaggacaauucaauccgacucucugcugguggggacauuugggugacgagagagccuuaugugucaugcgauccuggcaaguguuaucaauuugcacucgggcaggggaccacacuagacaacaaacauucaaaugacacaauacaugauagaaucccacaucgaacccuauugaugaaugaguuggguguuccauuucauuuaggaaccaggcaaguguguauagcaugguccagcucaaguugucacgaugggaaagcauggcugcauguuugugucacuggggaugauaaaaaugcaacugcuagcuucauuuaugacgggaggcuuguggacaguauugguucauggucucaaaauauccucaggacccaggagucggaaugcguuuguaucaaugguacuugcacaguaguaaugacugaugggagugcuucagggagagccgauacuagaauacuauucauugaagaggggaaaauuguccauauuagcccguugucaggaagugcucagcauguagaggaguguuccuguuauccucgauauccugacgucagauguaucugcagagacaacuggaaaggcucuaauaggcccaucguagacauaaauaugaaagauuauagcauugauuccaguuaugugugcucagggcuuguuggcgacacaccuagaaacgacgacagaucuagcaagagcaauugcaggaauccuaacaaugagagagggaaucacggagugaaaggcugggccuuugacaauggaaaugacguguggaugggaagaacgaucagcaaggauuuacgcucagguuaugaaacuuucaaagucauuggugguugguccacaccuaauuccaaaucgcagaucaauaggcaagucauaguugacagcgauaaucggucagguuauucugguauuuucucuguugagggcaaaagcugcaucaauaggugcuuuuauguggaguugauaaggggaagggaacaggagacuagaguaugguggacuucaaacaguauuguuguguuuuguggcacuucagguaccuauggaacaggcucauggccugauggggcgaacaucaacuucaugccuauauaa

SEQ ID NO: 52478 - RNA, 1410 nt, Artificial Sequence; identical to SEQ ID NO: 50631
  neuraminidase__InfluenzaA__AFG98833

SEQ ID NO: 52479 - RNA, 1410 nt, Artificial Sequence
  neuraminidase__InfluenzaA__AFG98844
augaauccaaaucaaaagauaauaacaauuggcucugucucucucaccauugcaacaauaugcuuccucaugcagauugccauccugguaacuacuguaacauugcauuucaagcaauaugagugcgacucccccgcgaacaaccaagugaugccgugugaaccaauaauaauagaaaggaacauaacagagauaguguauuugacuaacaccaccauagagaaagagaugugccccaaauuaguggaauacaggaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuaaacaacagacauucaaaugacacaauacaugauagaaucccucaucgaacccuauugaugaaugaguuggguguuccauuucauuugggaaccaggcaaguguguauagcaugguccagcucaaguugucacgauggaaaagcauggcugcauguuugugucacuggggaugauaaaaaugcaacugcuagcuucauuuacgaugggaggcuuguggacaguauugguucauggucucaaaauauccucaggacccaggagucggaaugcguuuguaucaauaggacuuguacaguaguaaugacugauggaagugcuucaggaaaagcugauacuagaauacuauucauugaagaggggaaaauuguucauauuagcccauugucaggaagugcucagcauguagaggaguguuccuguuauccucgauauccuggugucagauguaucugcagagacaacuggaaaggcucuaauaggcccgucguagauauaaaugugaaagauuauagcauugauuccaguuaugugugcucagggcuuguuggcgacacacccagaaacaacgacagaucuagcaguagcuauugccggaauccuaacaaugagagagggaaucacggagugaaaggcugggccuuugacgaugaaaaugacguguggaugggaagaacgaucagcaaggauucacgcucagguuaugaaaccuucaaagucauuggugguugguccacaccuaauuccaaaucgcagauaaauaggcaagucauaguugacagcgauaauaggucagguuauucugguauuuucucuguugagggcaaaagcugcaucaauaggugcuuuuauguggaguuaauaaggggaagggaacaggagacuagaguaugguggaccucaaacaguauuguuguguuuuguggcacuucagguaccuaugggacaggcucauggccugauggggcggacaucaaucucaugccuauauaa

SEQ ID NO: 52480 - RNA, 1410 nt, Artificial Sequence; identical to SEQ ID NO: 44837
  neuraminidase__InfluenzaA__AFG98855

SEQ ID NO: 52481 - RNA, 1410 nt, Artificial Sequence
  neuraminidase__InfluenzaA__AFG98866
augaauccaaaucaaaagauaauaacaauuggcucugucucucucaccauugcaacaauaugcuuccucaugcagauugccauccugguaacuacuguaacauugcauuucaagcaauaugagugcgacucccccgcgaacaaccaaguaaugccgugugaaccaauaauaauagaaaggaacauaacagagauaguguauuugacuaacaccaccauagagaaagagauaugccccaaauuaguggaauacaggaaauggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcagggaaccacacuagacaacaaacauucaaaugacacaauacaugauagaaucccucaucgaacccuauugaugaaugaguuggguguuccauuucauuugggaaccaggcaaguguguauagcaugguccagcucaaguugucacgauggaaaagcauggcugcauguuugugucacuggggaugauaaaaaugcaacugcuagcuucauuuacgaugggaggcuuguggacaguauugguucauggucucaaaauauccucaggacccaggagucggaaugcguuuguaucaaugggacuuguacaguaguaaugacugauggaagugcuucaggaagagcugauacuagaauacuauucauugaagaggggaaaauuguucauauuagcccauugucaggaagugcucagcauguagaggaguguuccuguuauccucgauauccuggugucagauguaucugcagagacaacuggaaaggcucuaauaggcccgucguagauauaaaugugaaagauuauagcauugauuccaguuaugugugcucagggcuuguuggcgacacacccagaaacaaugacagaucuagcaauagcuauugccggaauccuaacaaugagagagggaaucacggagugaaaggcugggccuuugacgauggaaaugacguguggaugggaagaacgaucagcaaggauucacgcucagguuaugaaaccuucaaagucauuggugguugguccacaccuaauuccaaaucgcagauaaauaggcaagucauaguugacagcgauaauaggucagguuauucugguauuuucucuguugagggcaaaagcugcaucaauaggugcuuuuauguggaguugauaaggggaagggaacaggagacuagaguaugguggaccucaaacaguauuguuguguuuuguggcacuucagguaccuaugggacaggcucauggccugauggggcggacaucaaucucaugccuauauaa

SEQ ID NO: 52482 - RNA, 1410 nt, Artificial Sequence
  neuraminidase__InfluenzaA__AFG98877
augaauccaaaucaaaagauaauaacaauuggcucugucucucucaccauugcaacaauaugcuuccucaugcagauugccauccugguaacuacuguaacauugcauuucaagcaauaugagugcgacucccccccgaacaaccaaguaaugccgugugaaccaauaauaauagaaaggaacauaacagagauaguguauuugacuaacaccaccauagagaaagagauaugccccaaauuaguggaauacaggaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaccccucaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucauggucucaaaauauccucaggacccaggagucggaaugcguuuguaucaaugggacuuguacaguaguaaugacugauggaagugcuucaggaagagcugauacuaaaauacuauucauugaagaggggaaaauuguucauauuagcccauugucaggaagugcucagcauguagaggaguguuccuguuauccucgauauccuggugucagauguaucugcagagacaacuggaaaggcucuaauaggcccgucguagauauaaaugugaaagauuauagcauugauuccaguuaugugugcucagggcuuguuggcgacacacccagaaacaacgacagaucuagcaauagcuauugccggaauccuaacaaugagaaagggaaucacggagugaaaggcugggccuuugacgauggaaaugacguguggaugggaagaacgaucagcgaggauucacgcucagguuaugaaaccuucaaagucauuggugguugguccacaccuaauuccaaauugcagauaaauaggcaagucauaguugacagcgauaauaggucagguuauucugguauuuucucuguugagggcaaaagcugcaucaauaggugcuuuuauguggaguugauaaggggaagggaacaggaaacuagaguaugguggaccucaaacaguauuguuguguuuuguggcacuucagguaccuaugggacaggcucauggccugauggggcggacaucaaucucaugccuauauaa

SEQ ID NO: 52483 - RNA, 1410 nt, Artificial Sequence
  neuraminidase__InfluenzaA__AFG98888
augaauccaaaucaaaagauaauaacaauuggcucugucucucucaccauugcaacaauaugcuuccucaugcagauugccauccugguaacuacuguaacauugcauuucaagcaauaugagugcgacucccccgcgaacaaccaaguaaugccgugugaaccaauaauaauagaaaggaacauaacagagauaguguauuugacuaacaccaccauagagaaagagauaugccccaaauuaguggaauacaggaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaaacauucaaaugauacaauacaugauagaaccccucaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucauggucucaaaauauccucaggacccaggagucggaaugcguuuguaucaaugggacuuguacaguaguaaugacugauggaagugcuucaggaagagcugauacuaaaauacuauucauugaagaggggaaaauuguucauaucagcccauugucaggaagugcucagcauguagaggaguguuccuguuauccucgauauccuggugucagauguaucugcagagacaacuggaaaggcucuaauaggcccgucguagauauaaaugugaaagauuauagcauugauuccaguuaugugugcucagggcuuguuggcgacacacccagaaacaacgacagaucuagcaauagcuauugccggaauccuaacaaugagaaagggaaucacggagugaaaggcugggccuuugacgauggaaaugacguguggaugggaagaacgaucagcgaggauucacgcucagguuaugaaaccuucaaagucauuggugguugguccacaccuaauuccaaauugcagauaaauaggcaagucauaguugacagcgauaauaggucagguuauucugguauuuucucuguugagggcaaaagcugcaucaauaggugcuuuuauguggaguugauaaggggaagggaacaggaaacuagaguaugguggaccucaaacaguauuguuguguuuuguggcacuucagguaccuaugggacaggcucauggccugauggggcggacaucaaucucaugccuauauaa

SEQ ID NO: 52484 - RNA, 1410 nt, Artificial Sequence
  neuraminidase__InfluenzaA__AFG98899
augaauccaaaucaaaagauaauaacaauuggcucugucucucucaucauugcaacaauaugcuuccucaugcagauugccauccugguaacuaccguaacauugcauuucaagcaauaugagugcgacucccccgcgaacaaccaaguaaugccgugugaaccaauaauaauagaaaggaacauaacagagauaguguauuugacuaacaccaccauagagaaagagauaugccccaaauuaguggaauacaggaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaccccucaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucauggucucaaaauauccucaggacccaggagucggaaugcguuuguaucaaugggacuuguacaguaguaaugacugauggaagugcuucaggaagagcugauacuaaaauacuauucauugaagaggggaaaauuguucauauuagcccauugucaggaagugcucagcauguagaggaguguuccuguuauccucgauauccuggugucagauguaucugcagagacaacuggaaaggcucuaauaggcccgucguagauauaaaugugaaagauuauagcauugauuccaguuaugugugcucagggcuuguuggcgacacacccagaaacaacgacagaucuagcaauagcuauugccggaauccuaacaaugagaaagggaaucacggagugaaaggcugggccuuugacgauggaaaugacguguggaugggaagaacgaucagcgaggauucacgcucagguuaugaaaccuucaaagucauuggugguugguccacaccuaauuccaaauugcagauaaauaggcaagucauaguugacagcgauaauagaucagguuauucugguauuuucucuguugagggcaaaagcugcaucaauaggugcuuuuauguggaguugauaaggggaagggaacaggaaacuagaguaugguggaccucaaacagcauuguuguguuuuguggcacuucagguaccuaugggacaggcucauggccugauggggcggacaucaaucucaugccuauauaa

SEQ ID NO: 52485 - RNA, 1410 nt, Artificial Sequence
  neuraminidase__InfluenzaA__AFG98910
augaauccaaaucaaaagauaauaacaauuggcucugucucucucaccauugcaacaauaugcuuccucaugcagauugccauccugguaacuaccguaacauugcauuucaagcaauaugagugcgacucccccgcgaacaaccaaguaaugccgugugaaccaauaauaauagaaaggaacauaacagagauaguguauuugacuaacaccaccauagagaaagagauaugccccaaauuaguggaauacaggaauuggucaaagccgcaauguaaaauuacaggauuugcaccuuuuuccaaggacaauucaauucggcuuucugcugguggggacauuugggugacgagagaaccuuaugugucaugcgauccuggcaaguguuaucaauuugcacucggucaggggaccacacuagacaacaaacauucaaaugacacaauacaugauagaaccccucaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucauggucucaaaauauccucaggacccaggagucggaaugcguuuguaucaaugggacuuguacaguaguaaugacugauggaagugcaucaggaagagcugauacuaaaauacuauucauugaagaggggaaaauuguucauauuagcccauugucaggaagugcucagcauguagaggaguguuccuguuauccucgauauccuggugucagauguaucugcagagacaacuggaaaggcucuaauaggcccgucguagauauaaaugugaaagauuauagcauugauuccaguuaugugugcucagggcuuguuggcgacacacccagaaacaacgacagaucuagcaauagcuauugccggaauccuaacaaugagaaagggaaucacggagugaaaggcugggccuuugacgauggaaaugacguguggaugggaagaacgaucagcgaggauucacgcucagguuaugaaaccuucaaagucauuggugguugguccacacccaauuccaaauugcagauaaauaggcaagucauaguugacagcgauaauagaucagguuauucugguauuuucucuguugagggcaaaagcugcaucaauaggugcuuuuauguggaguugauaaggggaagggaacaggaaacuagaguaugguggaccucaaacaguauuguuguguuuuguggcacuucagguaccuaugggacaggcucauggccugauggggcggacaucaaucucaugccuauauaa

SEQ ID NO: 52486 - RNA, 1410 nt, Artificial Sequence; identical to SEQ ID NO: 52485
  neuraminidase__InfluenzaA__AFG98921

SEQ ID NO: 52487 - RNA, 1410 nt, Artificial Sequence
  neuraminidase__InfluenzaA__AFG98932
augaauccaaaucaaaagauaauaacaauuggcucugucucucucaccauugcaacaauaugcuuccucaugcagauugccauccugguaacuaccguaacauugcauuucaagcaauaugagugcgacucccccgcgaacaaccaaguaaugccgugugaaccaauaauaguagaaaggaacauaacagagauaguguauuugacuaacaccaccauagagaaagagauaugccccaaauuaguggaauacaggaaauggucaaagccgcaauguaaaauuacaggauuugcaccuuuuuccaaggacaauucaauucggcuuucugcugguggggacauuugggugacgagagaaccuuaugugucaugcgauccuggcaaguguuaucaauuugcacucggucaggggaccacacuagacaacaaacauucaaaugacacaauacaugauagaaccccucaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucauggucucaaaauauccucaggacccaggagucggaaugcguuuguaucaaugggacuuguacaguaguaaugacugauggaagugcaucaggaagagcugauacuaaaauacuauucauugaagaggggaaaauuguucauauuagcccauugucaggaagugcucagcauguagaggaguguuccuguuauccucgauauccuggugucagauguaucugcagagacaacuggaaaggcucuaauaggcccgucguagauauaaaugugaaagacuauagcauugauuccaguuaugugugcucagggcuuguuggcgacacacccagaaacaacgacagaucuagcaauagcuauugccggaauccuaacaaugagaaagggaaucacggagugaaaggcugggccuuugacgauggaaaugacguguggaugggaagaacaaucagcgaggauucacgcucagguuaugaaaccuucaaagucauuggugguugguccacacccaauuccaaauugcagauaaauaggcaagucauaguugacagugauaauagaucagguuauucugguauuuucucuguugagggcaaaagcugcaucaauaggugcuuuuauguggaguugauaaggggaagggaacaggaaacuagaguaugguggaccucaaacaguauuguuguguuuuguggcacuucagguaccuaugggacaggcucauggccugauggggcggacaucaaucucaugccuauauaa

SEQ ID NO: 52488 - RNA, 1410 nt, Artificial Sequence
  neuraminidase__InfluenzaA__AFG98943
augaauccaaaucaaaagauaauaacaauuggcucugucucucucaccauugcaacaauaugcuuccucaugcagauugccauccugguaacuaccguaacauugcauuucaagcaauaugagugcgacucccccgcgaacaaccaaguaaugccgugugaaccaauaauaauagaaaggaacauaacagagauaguguauuugacuaacaccaccauagagaaagagauaugccccaaauuaguggaauacaggaauuggucaaagccgcaauguaaaauuacaggauuugcaccuuuuuccaaggacaauucaauucggcuuucugcugguggggacauuugggugacgagagaaccuuaugugucaugcgauccuggcaaguguuaucaauuugcacucggucaggggaccacacuagacaacaaacauucaaaugacacaauacaugauagaaccccucaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucauggucucaaaauauccucaggacccaggagucggaaugcguuuguaucaaugggacuuguacaguaguaaugacugauggaagugcaucaggaagagcugauacuaaaauacuauucauugaagaggggaaaauuguucauauuagcccauugucaggaagugcucagcauguagaggaguguuccuguuauccucgauauccuggugucagauguaucugcagagacaacuggaaaggcucuaauaggcccgucguagauauaaaugugaaagauuauagcauugauuccaguuaugugugcucagggcuuguuggcgacacacccagaaaaaacgacagaucuagcaauagcuauugccggaauccuaacaaugagaaagggaaucacggagugaaaggcugggccuuugacgauggaaaugacguguggaugggaagaacgaucagcgaggauucacgcucagguuaugaaaccuucaaagucauuggugguugguccacacccaauuccaaauugcagauaaauaggcaagucauaguugacagcgauaauagaucagguuauucugguauuuucucuguugagggcaaaagcugcaucaauaggugcuuuuauguggaguugauaaggggaagggaacaggaaacuagaguaugguggaccucaaacaguauuguuguguuuuguggcacuucagguaccuaugggacaggcucauggccugauggggcggacaucgaucucaugccuauauaa

SEQ ID NO: 52489 - RNA, 1410 nt, Artificial Sequence
  neuraminidase__InfluenzaA__AFG98965
augaauccaaaucaaaagauaauaacaauuggcucugucucucucaccauugcaacaauaugcuuccucaugcagauugccauccugguaacuacuguaacauugcauuucaagcaguaugagugcgacucccccgcgaacaaucaaguaaugccgugugaaccaacaauaauagaaaggaacauaacagagauaguguauuugacuaacaucaccauagaaaaagagauaugccccaaauuaguggaauacaggaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaccccucaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucauggucucaaaauauccucaggacccaggagucggaaugcguuuguaucaaugggacuuguacaguaguaaugacugauggaagugcuucaggaagagcugauacuaaaauacuauucauugaagaggggaaaauuguucauauuagcccauugucaggaagugcucagcauguagaggaguguuccuguuacccucgauauccuggugucagauguaucugcagagacaacuggaaaggcucuaauaggcccgucguagauauaaaugugaaagauuauagcauugauuccaguuaugugugcucagggcuuguuggcgacacacccagaaacaacgacagaucuagcaauagcuauugccggaauccuaacaaugagaaagggaaucacggagugaaaggcugggccuuugacgauggaaaugacguguggaugggaagaacgaucagcgaggauucacgcucagguuaugaaaccuucaaagucauuggugguugguccacaccuaauuccaaauugcagauaaauaggcaagucauaguugacagcgauaauaggucagguuauucugguauuuucucuguugagggcaaaagcugcaucaauaggugcuuuuauguggaguugauaaggggaagggaacaggaaacuagaguaugguggaccucaaacaguauuguuguguuuuguggcacuucagguaccuauggggcaggcucauggccugauggggcggacaucaaucucaugccuauauaa

SEQ ID NO: 52490 - RNA, 1410 nt, Artificial Sequence
  neuraminidase__InfluenzaA__AFG98976
augaauccaaaucaaaagauaauaacaauuggcucugucucucucaccauugcaacaauaugcuuccucaugcagauugccauccugguaacuacuguaacauugcauuucaagcaauaugagugcgacucccccgcgaacaaccaaguaaugccgugugaaccaauaauaauagaaaggaacauaacagagauaguguauuuggcuaacaccaccauagagaaagagauaugccccaaauuaguggaauacagaaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaccccucaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucauggucuaaaaauauccucaggacccaggagucggaaugcguuuguaucaaugggacuuguacaguaguaaugacugauggaagugcuucaggaagagcugauacuaaaauacuauucauugaagaggggaaaauuguucauauuagcccauugucaggaagugcucaacauguagaggaguguuccuguuauccucgauauccuggugucagauguaucugcagagacaacuggaaaggcucuaauaggcccgucguagauauaaaugugaaagauuauagcauugauuccaguuaugugugcucagggcuuguuggcgacacacccagaaacaacgacagaucuagcaguagcuauugccggaauccuaacaaugagaaagggaaucauggagugaaaggcugggccuuugacgauggaaaugacguguggaugggaagaacgaucagcgaggauucacgcucagguuaugaaaccuucaaagucauuggugguugguccacaccuaauuccaaauugcagauaaauaggcaagucauaguugauagcgauaauaggucagguuauucugguguuuucucuguugagggcaaaagcugcaucaauagaugcuuuuauguggaguugauaaggggaagggaacuggaaacuagagucugguggaccucaaacaguauuguuguguuuuguggcacuucagguaccuaugggacaggcucauggccugauggggcggacaucaaucucaugccuauauaa

SEQ ID NO: 52491 - RNA, 1410 nt, Artificial Sequence; identical to SEQ ID NO: 52490
  neuraminidase__InfluenzaA__AFG98987

SEQ ID NO: 52492 - RNA, 1410 nt, Artificial Sequence
  neuraminidase__InfluenzaA__AFG98998
augaauccaaaucaaaagauaauaacaauuggcucugucucucucaccauugcaacaauaugcuuccucaugcagauugccauccugguaacuacuguaacauugcauuucaagcaauaugagugcgacucccccgcgaacaaccaaguaaugccgugugaaccaauaauaauagaaaggaacauaacagagauaguguauuugacuaacaccaccauagaaaaagagauaugccccaaauuaguggaauacaggaauuggucaaagccacaauguaaaauuacaggauuugcaccuuucucuaaggacaauucaauucggcuuucugcugguggggacauuugggugacgagagaaccuuaugugucaugcgauccuggcaaauguuaucaauuugcacucgggcaggggaccacacuagaaaacaaacauucaaaugacacaauacaugauagaaccccucaucgaacccuauugaugaaugaguuggguguuccauuucacuugggaaccaggcaaguguguauagcaugguccagcucaaguugucacgauggaaaagcauggcugcauguuugugucacuggguaugauaaaaaugcaacugcuagcuucauuuacgaugggaggcuuguagacagcauugguucauggucucaaaauauccucaggacccaggagucggaauguguuuguaucaaugggacuuguacaguaguaaugacugauggaagugcuucaggaagagcugauacuaaaauacuauucauugaagaggggaaaauuguucauauuagcccauugucaggaagugcucagcauguagaggaguguuccuguuauccucgauauccuggugucagauguaucugcagagacaacuggaaaggcucuaauaggccagucguagauauaaaugugaaagauuauagcauugauuccaguuaugugugcucagggcuuguuggcgacacacccagaaaaaacgacagaucuagcaguagcuauugccggaauccuaacaaugaaaaagggaaucacggagugaaaggcugggccuuugacgauggaaaugacguguggaugggaagaacgaucagcgaggauucacgcucagguuaugaaaccuucaaagucauuggugguugguccacaccuaauuccaaauugcagauaaauaggcaagucauaguugacagcgcuaauaggucagguuauucugguauuuucucuguugagggcaaaagcugcaucaauaggugcuuuuauguggaguugauaaggggaagggaacaggaaacuagaguaugguggaccucaaacaguauuguuguguuuuguggcacuucagguaccuaugggacaggcucauggccugauggggcggacaucaaucucaugccuauauaa

SEQ ID NO: 52493 - RNA, 1410 nt, Artificial Sequence
  neuraminidase__InfluenzaA__AFG99009
augaauccaaaucaaaagauaauaacaauuggcucugucucucucaccauugcaacaauaugcuuccucaugcagauugccauccugguaacuacuguaacauugcauuucaagcaauaugagugcgacucccccgcgaacaaccaaguaaugccgugugaaccaauaauaauagaaaggaacauaacagagauaguguauuuggcuaacaccaccauagagaaagagauaugccccaaauuaguggaauacagaaauuggucaaagccgcaauguaaaauuacaggauuugcaccuuuuuccaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaccccucaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucauggucuaaaaauauccucaggacccaggagucggaaugcguuuguaucaaugggacuuguacaguaguaaugacugauggaagugcuucaggaagagcugauacuaaaauacuauucauugaagaggggaaaauuguucauauuagcccauugucaggaagugcucaacauguagaggaguguuccuguuauccucgauauccuggugucagauguaucugcagagacaacuggaaaggcucuaauaggcccgucguagauauaaaugugaaagauuauagcauugauuccaguuaugugugcucagggcuuguuggcgacacacccagaaacaacgacagaucuagcaguagcuauugccggaauccuaacaaugagaaagggaaucauggagugaaaggcugggccuuugacgauggaaaugacguguggaugggaagaacgaucagcgaggauucacgcucagguuaugaaaccuucaaagucauuggugguugguccacaccuaauuccaaauugcagauaaauaggcaagucauaguugauagcgauaauaggucagguuauucugguguuuucucuguugagggcaaaagcugcaucaauagaugcuuuuauguggaguugauaaggggaagggaacuggaaacuagagucugguggaccucaaacaguauuguuguguuuuguggcacuucagguaccuaugggacaggcucauggccugauggggcggacaucaaucucaugccuauauaa

SEQ ID NO: 52494 - RNA, 1410 nt, Artificial Sequence
  neuraminidase__InfluenzaA__AFG99020
augaauccaaaucaaaagauaauaacaauuggcucugucucucucaccauugcaacaauaugcuuccucaugcagauugccauccugguaaccacuguaacauugcauuucaagcaauaugagugcgacuccccagcgaacaaccaaguaaugccgugugaaccaauaauaauagaaaggaacauaacagagauaguguauuugacuaacaccaccauagaaaaagagauaugccccaaauuaguggaauacaggaauuggucaaagccacaauguaaaauuacaggauuugcaccuuucucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaccccucaucgaacccuauugaugaaugaguuggguguuccauuucacuugggaaccaggcaaguguguauagcaugguccagcucaaguugucacgauggaaaagcauggcugcauguuugugucacuggguaugauaaaaaugcaacugcuagcuucauuuacgaugggaggcuuguagacagcauugguucauggucucaaaauauccucaggacccaggagucggaauguguuuguaucaaugggacuuguacaguaguaaugacugauggaagugcuucaggaagagcugauacuaaaauacuauucauugaagaggggaaaauuguucauacuagcccauugucaggaagugcucagcauguagaggaguguuccuguuauccucgauauccuggugucagauguaucugcagagacaacuggaaaggcucuaauaggccagucguagauauaaaugugaaagauuauagcauugauuccaguuaugugugcucagggcuugugggcgacacacccagaaacaaugacagaucuagcaguagcuauugccggaauccuaacaaugaaaaagggacucacggagugaaaggcugggccuuugacgauggaaaugacguguggaugggaagaacgaucagcgaggauucacgcucagguuaugaaaccuucaaagucauuggugguugguccacaccuaauuccaaauugcagauaaauaggcaagucauaguugacagcgauaauaggucagguuauucugguauuuucucuguugagggcaaaagcugcaucaauaggugcuuuuauguggaguugauaaggggaagggaacaggaaacuagaguaugguggaccucaaacaguauuguuguguuuuguggcacuucagguaccuaugggacaggcucauggccugauggggcggacaucaauaucaugccuauauaa

SEQ ID NO: 52495 - RNA, 1410 nt, Artificial Sequence
  neuraminidase__InfluenzaA__AFG99031
augaauccaaaucaaaagauaauaacaauuggcucugucucucucaccauugcaacaauaugcuuccucaugcagauugccauccugguaaccacuguaacauugcauuucaagcaauaugagugcgacuccccagcaaacaaccaaguaaugccgugugaaccaauaauaauagaaaggaacauaacagagauaguguauuugacuaacaccaccauagaaaaagagauaugccccaaauuaguggaauacaggaauuggucaaagccacaauguaaaauuacaggauuugcaccuuucucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaccccucaucgaacccuauugaugaaugaauuggguguuccauuucacuugggaaccaggcaaguguguauagcaugguccagcucaaguugucacgauggaaaagcauggcugcauguuugugucacuggguaugauaaaaaugcaacugcuagcuucauuuacgaugggaggcuuguagacagcauugguucauggucucaaaauauccucaggacccaggagucggaauguguuuguaucaaugggacuuguacaguaguaaugacugauggaagugcuucaggaagagcugauacuaaaauacuauucauugaagaggggaaaauuguucauacuagcccauugucaggaagugcucagcauguagaggaguguuccuguuauccucgauauccuggugucagauguaucugcagagacaacuggagaggcucuaauaggccagucguagauauaaaugugaaagauuauagcauugauuccaguuaugugugcucagggcuugugggcgacacacccagaaacaacgacagaucuagcaguagcuauugccggaauccuaacaaugaaaaagggacucacggagugaaaggcugggccuuugacgauggaaaugacguguggaugggaagaacgaucagcgaggauucacgcucagguuaugaaaccuucaaagucauuggugguugguccacaccuaauuccaaauugcagauaaauaggcaagucauaguugacagcgauaauaggucagguuauucugguauuuucucuguugagggcaaaagcugcaucaauaggugcuuuuauguggaguugguaaggggaagggaacaggaaacuagaguaugguggaccucaaacaguauuguuguguuuuguggcacuucagguaccuaugggacaggcucauggccugauggggcggacaucaaucucaugccuauauaa

SEQ ID NO: 52496 - RNA, 1410 nt, Artificial Sequence; identical to SEQ ID NO: 45080
  neuraminidase__InfluenzaA__AFG99042

SEQ ID NO: 52497 - RNA, 1410 nt, Artificial Sequence
  neuraminidase__InfluenzaA__AFG99053
augaauccaaaucaaaagauaauaacaauuggcucugucucucucaccauugcaacaauaugcuuccucaugcagauugccauccugguaaccacuguaacauugcauuucaagcaauaugagugcgacuccccagcgaacaaccaaguaaugccgugugaaccaauaauaauagaaaggaacauaacagagauaguguauuugacuaacaccaccauagaaaaagagauaugccccaaauuaguggaauacaggaauuggucaaagccacaauguaaaauuacaggauuugcaccuuucucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaccccucaucgaacccuauugaugaaugaguuggguguuccauuucacuugggaaccaggcaaguguguauagcaugguccagcucaaguugucacgauggaaaagcauggcugcauguuugugucacuggguaugauaaaaaugcaacugcuagcuucauuuacgaugggaggcuuguagacagcauugguucauggucucaaaauauccucaggacccaggagucggaauguguuuguaucaaugggacuuguacaguaguaaugacugauggaagugcuucaggaagagcugauacuaaaauacuauucauugaagaggggaaaauuguucauacuagcucauugucaggaagugcucagcauguagaggaguguuccuguuauccucgauauccuggugucagauguaucugcagagacaacuggaaaggcucuaauaggccagucguagauauaaaugugaaagauuauagcauugauuccaguuaugugugcucagggcuugugggcgacacacccagaaacaacgacagaucuagcaguagcuauugccggaauccuaacaaugaaaaagggacucacggagugaaaggcugggccuuugacgauggaaaugacguguggaugggaagaacgaucagcgaggauucacgcucagguuaugaaaccuucaaagucauuggugguugguccauaccuaauuccaaauugcagauaaauaggcaagucauaguugacagcgauaauaggucagguuauucugguauuuucucuguugagggcaaaagcugcaucaauaggugcuuuuauguggaguugauaaggggaagggaacaggaaacuagaguaugguggaccucaaacaguauuguuguguuuuguggcacuucagguaccuaugggacaggcucauggccugauggggcggacaucaaucucaugccuauauaa

SEQ ID NO: 52498 - RNA, 1410 nt, Artificial Sequence
  neuraminidase__InfluenzaA__AFG99064
augaauccaaaucaaaagauaauaacaauuggcucugucucucucaccauugcaacaguaugcuuccucaugcaaauugccauccugguaacuacuguaacauugcauuucaagcaauaugagugcgacucccccccgaacaaccaaguaaugccgugugaaccaauaauaauagaaaggaacguaacagagauaguguauuugacuaacaccaccauagagaaagagauaugccccaaauuaguggaauacagaaauuggucaaagccgcaauguaaaauuacaggauuugcaccuuuuucuaaggacaauucaauucgacuuucugcugguggggacauuugggugacgagagaaccuuaugugucaugcgauccuagcaaguguuaucaauuugcacucgggcaggggaccacacuagacaacaaacauucaaaugacacaauacaugauagaaccccucaucgaacccuauugaugaaugaguuggguguuccauuucauuugggaaccaggcaaguguguauagcaugguccagcucaaguugucacgauggaaaagcauggcugcauguuuguaucacuggguaugacaaaaaugcaacugcuagcuucauuuacgaugggaggcuuguagacaguauugguucauggucuaaaaauauccucaggacccaggagucggaaugcguuuguaucaaugggacuuguacaguaguaaugacugauggaagugcuucagaaagagcugacacuaaaauacuauucauugaagaggggaaaauuguucauauuagcccauugucaggaagugcucagcauguagaggaguguuccuguuauccucgauauccuggugucagauguaucugcagagacaacuggaaaggcucuaauaggcccgucguagauauaaaugugaaagauuauagcauuguuuccaguuaugugugcucagggcuuguuggcgacacacccagaaaaaacgacagaucuagcaguagcuauugccggaauccuaacaaugagaaagggaaucauggagugaaaggcugggccuuugacgauggaaaugacguguggaugggaagaacgaucagcgaggagucacgcucagguuaugaaaccuucaaagucauuggugguugguccacaccuaauuccaaauugcaaauaaauaggcaagucauaguugacagcgauaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcacuucagguaccuaugggacaggcucauggccugauggggcggacaucaaucucaugccuauauaa

SEQ ID NO: 52499 - RNA, 1410 nt, Artificial Sequence
  neuraminidase__InfluenzaA__AFG99086
augaauccaaaucaaaagauaauaacaauuggcucugucucucucaccauugcaacaauaugcuuccucaugcaaauugccauccugguaacuacuguaacauugcauuucaagcaauaugagugcgacucccccgcgaacaaccaaguaaugccgugugaaccaauaauaauagaaaggaacguaacagagauaguguauuugacuaacaccaccauagaaaaggagauaugccccaaauuaguggaauacagaaauuggucaaagccgcaauguaaaauuacaggauuugcaccuuuuucuaaggacaauucaauucgacuuucugcugguggggacauuugggugacgagagaaccuuaugugucaugcgauccuggcaaguguuaucaauuugcacucgggcaggggaccacacuagacaacaaacauucaaaugacacaauacaugauagaaccccuuaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucauggucuaaaaauauccucaggacccaggagucggaaugcguuuguaucaaugggacuuguacaguaguaaugacugauggaagugcuucagaaagagcugacacuaaaauacuauucauugaagaggggaaaauuguucauauuagcccauugucaggaagugcucagcauguagaggaguguuccuguuauccucgauauccuggugucagauguaucugcagagacaacuggaaaggcucuaauaggcccgucguagauauaaaugugaaagauuauagcauuguuuccaguuaugugugcucagggcuuguuggcgacacacccagaaaaaacgacagaucuagcaguagcuauugccggaauccuaacaaugagaaagggaaucauggagugaaaggcugggccuuugaugauggaaaugacguguggaugggaagaacgaucagcgaggagucacgcucagguuaugaaaccuucaaagucauuggugguugguccacaccuaauuccaaauugcagauaaauaggcaagucauaguugacagcgauaauagguccgguuauucugguauuuucucuguugagggcaaaagcugcaucaauaggugcuuuuauguggaguugauaaggggaagagaacaggaaacuagagucugguggacaucaaacaguauuguuguguuuuguggcacuucagguaccuaugggacaggcucauggccugauggggcggacaucaaucucaugccuauauaa

SEQ ID NO: 52500 - RNA, 1410 nt, Artificial Sequence
  neuraminidase__InfluenzaA__AFG99097
augaauccaaaucaaaagauaauaacaauuggcucugucucucucaccauugcaacaauaugcuuccucaugcaaauugccauccugguaacuacuguaacauugcauuucaagcaauaugagugcgacucccccgcgaacaaccaaguaaugccgugugaaccaauaauaauagaaaggaacguaacagagauaguguauuugacuaacaccaccauagaaaaagagauaugccccaaauuaguggaauacagaaauuggucaaagccgcaauguaaaauuacaggauuugcaccuuuuucuaaggacaauucaauucgacuuucugcugguggggacauuugggugacgagagaaccuuaugugucaugcgauccuggcaaguguuaucaauuugcacucgggcaggggaccacacuagacaacaaacauucaaaugacacaauacaugauagaaccccuuaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugacacuaaaauacuauucauugaagaggggaaaauuguucauauuagcccauugucaggaagugcucagcauguagaggaguguuccuguuauccucgauauccuggugucagauguaucugcagagacaacuggaaaggcucuaauaggcccgucguagauauaaaugugaaagauuauagcauuguuuccaguuaugugugcucagggcuuguuggcgacacacccagaaaaaacgacagaucuagcaguagcuauugccggaauccuaacaaugagaaagggaaucauggagugaaaggcugggccuuugaugauggaaaugacguguggaugggaagaacgaucagcgaggagucacgcuuagguuaugaaaccuucaaagucauuggugguugguccacaccuaauuccaaauugcagauaaauaggcaagucauaguugacagcgauaauagguccgguuauucugguauuuucucuguugagggcaaaagcugcaucaauaggugcuuuuauguggaguugauaaggggaagagaacaggaaacuagagucugguggacaucaaacaguauuguuguguuuuguggcacuucagguaccuaugggacaggcucauggccugauggagcggacaucaaucucaugccuauauaa

SEQ ID NO: 52501 - RNA, 1410 nt, Artificial Sequence
  neuraminidase__InfluenzaA__AFG99119
augaauccaaaucaaaagauaauaacaauuggcucugucucucucaccauugcaacaauaugcuuccuuaugcaaauugccauccugguaacuacuguaacauugcauuucaagcaauaugagugcagcucccccccaaacaaccaaguaaugccgugugaaccaauaauaauagaaagaaacauaacagagauaguguauuugacuaacaccaccauagagaaagagauaugccccaaacuaguggaauacagaaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaagcauucaaaugacacaauacaugauaggaccccuuaucgaacccuauugaugaaugaguuggguguuccauuucauuugggaaccaggcaaguguguauagcaugguccagcucaaguugucacgauggaaaagcauggcugcauguuugugucacugggcaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggaguguucauguuauccucgauauccuggugucagaugugucugcagagacaacuggaaaggcuccaauaggcccaucguagauauaaaugugaaagauuauagcauuguuuccaguuaugugugcucagggcuuguuggcgacacacccagaaaaaacgacagaucuagcaguagcuauugccggaauccuaacaaugagaaagggaaucauggagugaaaggcugggccuuugacgauggaaaugacguguggaugggaagaacgaucagcgaggagucacgcucagguuaugaaaccuucaaagucauuggugguugguccacaccuaauuccaaauugcagauaaauaggcaagucauaguugacagcgauaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcaccucagguaccuauggaacaggcucauggccugauggggcggacaucaaucucaugccuauauaa

SEQ ID NO: 52502 - RNA, 1410 nt, Artificial Sequence
  neuraminidase__InfluenzaA__AFG99130
augaauccaaaucaaaagauaauaacaauuggcucugucucucucaccauugcaacaauaugcuuccuuaugcaaauugccauccugguaacuacuguaacauugcauuucaagcaauaugagugcagcucccccccaaacaaccaaguaaugccguguggaccaauaauaauagaaagaaacauaacagagauaguguauuugacuaacaccaccauagagaaagagauaugccccaaacuaguggaauacagaaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaagcauucaaaugacacaauacaugauaggaccccuuaucgaacccuauugaugaaugaguuggguguuccauuucauuugggaaccaggcaaguguguauagcaugguccagcucaaguugucacgauggaaaagcauggcugcauguuugugucacugggcaugauaaaaaugcaacugcuagcuucauuuacgaugggaggcuuguagacaguauugguucaugguccaaaaauauccucaggacccaggagucggaaugcguuuguaucaaugggacuuguacaguaguaaugaccgauggaagugcuucagaaagagcugauacuaaaauacuauucauugaagaggggaaaaucguucauauuagcccauugucaggaagugcucagcauguagaggaguguuccuguuauccucgauauccuggugucagaugugucugcagagacaacuggaaaggcuccaauaggcccgucguagauauaaaugugaaagauuauagcauuguuuccaguuaugugugcucagggcuuguuggcgacacacccagaaaaaacgacagaucuagcaguagcuauugccggaauccuaacaaugagaaagggaaucauggagugaaaggcugggccuuugacgauggaaaugacguguggaugggaagaacgaucagcgaggagucacgcucagguuaugaaaccuucaaagucauuggugguugguccacaccuaauuccaaauugcagacaaauaggcaagucauaguugacagcgauaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcacuucagguaccuauggaacaggcucauggccugauggagcggacaucaaucucaugccuauauaa

SEQ ID NO: 52503 - RNA, 1410 nt, Artificial Sequence
  neuraminidase__InfluenzaA__AFG99141
augaauccaaaucaaaagauaauaacaauugguucugucucucucaccauugcaacaauaugcuuccuuaugcaaauugccauucugguaacuacuguaacauugcauuucaagcaauaugagugcagcucccccccaaacaaccaaguaaugccgugugaaccaauaauaauagaaagaaacauaacagagauaguguauuugacuaacaccaccauagagaaagagauaugccccaaacuaguggaauacagaaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaagcauucaaaugacacaauacaugauaggaccccuuaucgaacccuauugaugaaugaguuggguguuccauuucauuugggaaccaggcaaguguguauagcaugguccagcucaaguugucacgauggaaaagcauggcugcauguuugugucacugggcaugauaaaaaugcaacugcuagcuucauuuacgaugggaggcuuguagacaguauugguucaugguccaaaaauauccucaggacccaggagucggaauguguuuguaucaaugggacuuguacaguaguaaugacugauggaagugcuucagaaagagcugaaacuaaaauacuauucauugaagaggggaaaaucguucauauuagcccauugucaggaagugcucagcauguagaggaguguuccuguuauccucgauauccuggugucagaugugucugcagagacaacuggaaaggcuccaauaggcccgucguagauauaaaugugaaagauuauagcauuguuuccaguuaugugugcucagggcuuguuggcgacacacccagaaaaaacgacagaucuagcaguagcuauugccggaauccuaacaaugagaaagggaaucauggagugaaaggcugggccuuugacgauggaaaugacguguggaugggaagaacgaucagcgaggagucacgcucagguuaugaaaccuucaaggucauuggugguugguccacaccuaauuccaaauugcagauaaauaggcaagucauaguugacagcgauaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcacuucagguaccuauggaacaggcucauggccugauggagcggacaucaaucucaugccuauauaa

SEQ ID NO: 52504 - RNA, 1410 nt, Artificial Sequence
  neuraminidase__InfluenzaA__AFG99152
augaauccaaaucaaaagauaaugacaauuggcucuguuucucucaccauugcaacaauaugcuuccuuaugcaaauugccauccugguaacuacuguaacauugcauuucaagcauuaugaguucagcucccccccaaacaaccaaguaaugccgugugaaccaauaauaauagaaagaaacauaacagagauaguguauuugacuaacaccaccauagagaaagagguaugccccaaacuaguggaauacagaaauuggucaaagccgcaauguaaaauuacaggauuugcaccuuuuucuaaggacaauucaauucggcuuuccgcugguggggacauuugggugacgagagaaccuuaugugucaugcgauccuggcaaguguuaucaauuugcacucgggcagggaaccacacuaaacaacaagcauucaaaugacacaauacaugauaggaccccuuaucgaacccuauugaugaaugaguuggguguuccauuucauuugggaaccaggcaagugugcauagcaugguccagcucaaguugucacgauggaaaagcauggcugcauguuugugucacugggcaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucaggaagagcugacacuaaaauacuauucauugaagaggggaaaaucguucauauuagcccauugucaggaagugcccagcauguagaggaguguuccuguuauccucgauauccuggugucagauguguuugcagagacaacuggaaaggcuccaauaggcccaucguagauauaaaugugaaagauuauagcauuguuuccaguuaugugugcucagggcuuguuggcgacacacccagaaaaaacgacagaucuagcaguagcuauugccggaauccuaacaaugagaaagggaaucauggagugaaaggcugggccuuugacgauggaaaugacguguggaugggaagaacgauuggcgaggaguuacgcucagguuaugaaaccuucaaagucauuggugguugguccacaccuaauuccaaauugcagauaaauagacaagucauaguugacagcgauaauagguccgguuauucugguauuuucucuguugagggcaaaagcugcaucaauaggugcuuuuauguggaguugauaagaggaagggaacaggaaacuagagucuuguggaccucaaacaguauuguuguguuuuguggcaccucagguaccuauggaacaggcucauggccugauggagcggacaucaaucucaugccuauauaa

SEQ ID NO: 52505 - RNA, 1410 nt, Artificial Sequence; identical to SEQ ID NO: 49499
  neuraminidase__InfluenzaA__AFG99163

SEQ ID NO: 52506 - RNA, 1410 nt, Artificial Sequence
  neuraminidase__InfluenzaA__AFG99174
augaauccaagucaaaagauaauaacaauugguucugucucucucaccauugcaacaauaugcuuccuuaugcaaaucgccauucugguaacuacuguaacauugcauuucaagcaauaugagugcagcucccccccaaacaaccaaguaaugccgugugaaccaauaauaauagaaagaaacauaacagagauaguguauuugacuaacaccaccauagagaaagagauaugccccaaacuaauggaauacagaaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaagcauucaaaugacacaauacaugauaggaccccuuaucgaacccuacugaugaaugaguuggguguuccauuucauuugggaaccaggcaaguguguauagcaugguccagcucaaguugucacgauggaaaagcauggcugcauguuugugucacugggcaugauaaaaaugcaacugcuagcuucauuuacgaugggaggcuuguggacaguauugguucaugguccaaaaauauccucaggacccaggagucggaauguguuuguaucaaugggacuuguacaguaguaaugacugauggaagugcuucagaaagagcugaaacuaaaauacuauucauugaagaggggaaaaucguucauauuagcccauugucaggaagugcucagcauguagaggaguguuccuguuauccucgauauccuggugucagaugugucugcagagacaacuggaaaggcuccaauaggcccgucguagauauaaaugugaaagauuauagcauuguuuccaguuaugugugcucagggcuuguuggugacacacccagaaaaaacgacagaucuagcaguagcuauugucggaauccuaacaaugagaaagggaaucauggagugaaaggcugggccuuugacgauggaaaugacguguggaugggaagaacgaucagcgaggagucacgcucagguuaugaaaccuucaaggucauuggugguugguccacaccuaauuccaaauugcagauaaauaggcaagucauaguugacagcgauaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcacuucagguaccuauggaacaggcucauggccugauggagcggacaucaaucucaugccuauauaa

SEQ ID NO: 52507 - RNA, 1410 nt, Artificial Sequence
  neuraminidase__InfluenzaA__AFG99185
augaauccaaaucaaaagauaauaacaauuggcucuguuucucucaccauugcaacaauaugcuuccuuaugcaaauugccauccugguaacuacuguaacacugcauuucaagcaauaugagugcagcucccccccaaacaaucaaguaaugccgugugaaccaauaauaauagaaagaaacauaacagagauaguguauuugacuaacaccaccauagagaaagagauaugccccaaacuaguggaauacagaaauuggucaaagccgcaauguaaaauuacaggauuugcaccuuuuucuaaggacaauucaauucggcuuuccgcugguggggacauuugggugacgagagaaccuuaugugucaugcgauccuggcaaguguuaucaauuugcacucgggcagggaaccacacuaaacaacaagcauucaaaugacacaauacaugauaggaccccuuaucgaacccuauugaugaaugaguugggugucccauuucauuugggaaccaagcaagugugcauagcaugguccagcucaaguugucacgauggaaaagcauggcugcauguuugugucacugggcaugauaaaaaugcaacugcuagcuucauuuacgaugggaggcuuguagacaguauugguucaugguccaaaaauauucucaggacccaggagucggagugcguuuguaucaaugggacuuguacaguaguaaugacugauggaagugcuucagaaagagcugauacuaaaauacuauucauugaagaggggaaaaucguucauauuagcccauugucaggaagugcucagcauguagaggaguguuccuguuauccucgguauccuggugucagaugugucugcagagacaacuggaaaggcuccaauaggcccaucguagauauaaaugugaaagauuauagcauuguuuccaguuaugugugcucagggcuuguuggcgacacacccagaaaaaacgacagauccagcaguagcuauugccggaauccuaacaaugagaaagggaaucauggagugaaaggcugggccuuugacgauggaaaugacguguggaugggaagaacgauuggcgaggaguuacgcucagguuaugaaaccuucaaagucauuggugguugguccacaccuaacuccaaauugcagauaaauaggcaagucauaguugacagcaaaaauaggucagguuauucugguauuuucucuguugagggcaaaagcugcaucaauaggugcuuuuauguggaguugauaaggggaagggaacaggaaacuagagucugguggaccucaaacaguauuguuguguuuugugguaccucagguacauauggaacaggcucauggccugauggagcggacaucaaucucaugccuauauaa

SEQ ID NO: 52508 - RNA, 1410 nt, Artificial Sequence
  neuraminidase__InfluenzaA__AFG99196
augaauccaaaucaaaagauaauaacaauuggcucuguuucucucaccauugcaacaauaugcuuccuuacgcaaauugccauccugguaacuacuguaacauugcauuucaagcaauaugagugcagcuccuccccaaacaaccaaguaaugccgugugaaccaauaauaauagaaagaaacauaacagagauaguguauuugacuaacaccaccauagagaaagagauaugccccaaacuaguggaauacagaaauuggucaaagccgcaauguaaaauuacaggauuugcaccuuuuucuaaggacaauucaauucggcuuuccgcugguggggacauuugggugacgagagaaccuuaugugucaugcgauccuggcaaguguuaucaauuugcacucgggcagggaaccacacuaaacaacaagcauucaaaugacacaauacaugauaggaccccuuaucgaacccuauugaugaaugaguuggguguuccauuucauuugggaaccaagcaagugugcauagcaugguccagcucaaguugucacgauggaaaagcauggcugcauguuuguaucacugggcaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggaguguuccuguuauccucgauauccuggugucagaugugucugcagagacaacuggaaaggcuccaauaggcccaucguagauauaaauguaaaagauuauagcauuguuuccaguuaugugugcucagggcuuguuggcgacacacccagaaaaaacgacagauccagcaguagcuauugccggaauccuaacaaugagaaagggaaucauggagugaaaggcugggccuuugacgauggaaaugacguguggaugggaagaacgauuggcgaggaguuacgcucagguuaugaaaccuucaaagucauuggugguugguccacaccuaacuccaaauugcagauaaauaggcaagucauaguugacagcgguaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcaccucagguacauauggaacaggcucauggccugauggagcggacaucaaucucaugccuauauaa

SEQ ID NO: 52509 - RNA, 1410 nt, Artificial Sequence
  neuraminidase__InfluenzaA__AFG99207
augaauccaaaucaaaagauaauaacaauuggcucuguuucucucaccauugcaacaauaugcuuccuuaugcaaauugccauccugguaacuacuguaacacugcauuucaagccauaugagugcagcucccccccaaacaaccaaguaaugccgugugaaccaauaauaauagaaagaaacauaacagagauaguguauuugacuaacaccaccauagagaaagagauaugccccaaacuaguggaauacagaaauuggucaaagccgcaauguaaaauuacaggauuugcaccuuuuucuaaggacaauucaauucggcuuuccgcugguggggacauuugggugacgagagaaccuuaugugucaugcgauccuggcaaguguuaucaauuugcacucgggcagggaaccacacuaaacaacaagcauucaaaugacacaauacaugauaggaccccuuaucgaacccuauugaugaaugaguugggugucccauuucauuuggggaccaagcaagugugcauagcaugguccagcucaaguugucacgauggaaaagcauggcugcauguuugugucacugggcaugauaaaaaugcaacugcuagcuucauuuacgaugggaggcuuguagacaguauugguucaugguccaaaaauauccucaggacccaggagucggagugcguuuguaucaaugggacuuguacaguaguaaugacugauggaagugcuucagaaagagcugauacuaaaauacuauucauugaagaggggaaaaucguucauauuagcccauugucaggaagugcucaacauguagaggaguguuccuguuauccucgauauccuggugucagaugugucugcagagacaacuggaaaggcuccaauaggcccaucguagauauaaaugugaaagauuauagcauuguuuccaguuaugugugcucagggcuuguuggcgacacacccagaaaaaacgacagauccagcaguagcuauugccggaauccuaacaaugagaaagggaaucauggagugaaaggcugggccuuugacgauggaaaugacguguggaugggaagaacgauuggcgaggaguuacgcucagguuaugaaaccuucaaagucauuggugguugguccacaccuaacuccaaauugcagauaaauaggcaagucauaguugacagcaaaaguaggucagguuauucugguauuuucucuguugagggcaaaagcugcaucaauaggugcuuuuauguggaguugauaaggggaagggaacaggaaacuagagucugguggaccucaaacaguauuguuguguuuuguggcaccucagguacauauggaacaggcucauggccugauggagcggacaucaaucucaugccuauauaa

SEQ ID NO: 52510 - RNA, 1410 nt, Artificial Sequence
  neuraminidase__InfluenzaA__AFG99218
augaauccaaaucaaaagauaauaacaauuggcucuguuucucucaccauugcaacaauaugcuuccuuaugcaaauugccauccugguaacuacuguaacacugcauuucaagcaauaugagugcagcucccccccaaacaaucaaguaaugccgugugaaccaauaauaauagaaagaaacauaacaaagauaguguauuugacuaacaccaccauagagaaagagauaugccccaaacuaguggaauacagaaauuggucaaagccgcaauguaaaauuacaggauuugcaccuuuuucuaaggacaauucaauucggcuuuccgcugguggggacauuugggugacgagagaaccuuaugugucaugcgauccuggcaaguguuaucaauuugcacucgggcagggaaccacacuaaacaacaagcauucaaaugacacaauacaugauaggaccccuuaucgaacccuauugaugaaugaguugggggucccauuucauuugggaaccaagcaagugugcauagcaugguccagcucaaguugucacgauggaaaagcauggcugcauguuugugucacugggcaugauaaaaaugcaacugcuagcuucauuuacgaugggaggcuuguagacaguauugguucaugguccaaaaauauucucaggacccaggagucggagugcguuuguaucaauggaacuuguacaguaguaaugacugauggaagugcuucagaaagagcugauacuaaaauacuauucauugaagaggggaaaauaguucauauuagcccauugucaggaagugcucagcauguagaggaguguuccuguuauccucgguauccuggugucagaugugucugcagagacaacuggaaaggcuccaauaggcccaucguagauauaaaugugaaagauuauagcauuguuuccaguuaugugugcucagggcuuguuggcgacacacccagaaaaaacgacagauccagcaguagcuauugccagaauccuaacaaugagaaagggaaucauggagugaaaggcugggccuuugacgauggaaaugacguguggaugggaagaacgauuggcgaggaguuacgcucagguuaugaaaccuucaaagucauuggugguugguccacaccuaacuccaaauugcagauaaauaggcaagucauaguugacagcaaaaauaggucagguuauucugguauuuucucuguugagggcaaaagcugcaucaauaggugcuuuuauguggaguugauaaggggaagggaacaggaaacuagagucugguggaccucaaacaguauuguuguguuuuguggcaccucagguacauauggaacaggcucauggccugauggagcggacaucaaucucaugccuauauaa

SEQ ID NO: 52511 - RNA, 1410 nt, Artificial Sequence
  neuraminidase__InfluenzaA__AFG99229
augaauccaaaucaaaagauaauaacaauuggcucuguuucucucaccauugcaacaauaugcuuccuuaugcaaauugccauccugguaacuacuguaacacugcauuucaagcaauaugagugcagcucccccccaaacaaucaaguaaugccgugugaaccaauaauaauagaaagaaacauaacaaagauaguguauuugacuaacaccaccauagagaaagagauaugccccaaacuaguggaauacagaaauuggucaaagccgcaauguaaaauuacaggauuugcaccuuuuucuaaggacaauucaauucggcuuuccgcugguggggacauuugggugacgagagaaccuuaugugucaugcgauccugggaaguguuaucaauuugcacucgggcagggaaccacacuaaacaacaagcauucaaaugacacaauacaugauaggaccccuuaucgaacccuauugaugaaugaguugggugucccauuucauuugggaaccaagcaagugugcauagcaugguccagcucaaguugucacgauggaaaagcauggcugcauguuugugucacugggcaugacaaaaaugcaacugcuagcuucauuuacgaugggaggcuuguagacaguauugguucaugguccaaaaauauucucaggacccaggaaucggagugcguuuguaucaaugggacuuguacaguaguaaugacugauggaagugcuucagaaagagcugauacuaaaauacuauucauugaagaggggaaaaucguucauauuagcccauugucaggaagugcucagcauguagaggaguguuccuguuauccucgguauccuggugucagaugugucugcagagacaacuggaaaggcuccaauaggcccaucguagauauaaaugugaaagauuauagcauuguuuccaguuaugugugcucagggcuuguuggcgacacacccagaaaaaacgacagauccagcaguagcuauugccggaauccuaacaaugagaaagggaaucauggagugaaaggcugggccuuugacgauggaaaugacguguggaugggaagaacgauuggcgaggaguuacgcucagguuaugaaaccuucaaagucauuggugguugguccacaccuaacuccaaauugcagauaaauaggcaagucauaguugacagcaaaaauaggucagguuauucugguauuuucucuguugagggcaaaagcugcaucaauaggugcuuuuauguggaguugauaaggggaagggaacaggaaacuagagucugguggaccucaaacaguauuguuguguuuugugguaccucagguacauauggaacaggcucauggccugauggagcggacaucaaucucaugccuauauaa

SEQ ID NO: 52512 - RNA, 1410 nt, Artificial Sequence
  neuraminidase__InfluenzaA__AFG99240
augaauccaaaucaaaagauaauaacaauuggcucuguuucucucaccauugcaacaauaugcuuccuuaugcaaauugccauccugguaacuacuguaacacugcauuucaagcaauaugagugcagcucccccccaagcaaucaaguaaugccgugugaaccaauaauaauagaaagaaacauaacagagauaguguauuugaccaacaccaccauagagaaagagauaugccccaaaccaguggaauacagaaauuggucaaagccgcaaugcaaaauuacaggauuugcacccuuuucuaaggacaauucaauucggcuuuccgcugguggggacauuugggugacgagagaaccuuaugugucaugcgauccuggcaaguguuaucaauuugcacucgggcagggaaccacacuaaacaacaagcauucaaaugacacaauacaugauaggaccccuuaucgaacccuauugaugaaugaguugggugucccauuucauuugggaaccaagcaagugugcauagcaugguccagcucaaguugucacgauggaaaagcauggcugcauguuugugucacugggcaugauaaaaaugcaacugcuagcuucauuuacgaugggaggcuuguagacaguauugguucaugguccaaaaauauucucaggacccaggagucggagugcguuuguaucaaugggacuuguacaguaguaaugacugauggaagugcuucagaaagagcugauacuaaaauacuauucauugaagaggggaaaaucguucauauuagcccauuaucaggaagugcucagcauguagaggaguguuccuguuauccucgguauccuggugucagaugugucugcagagacaacuggaaaggcuccaauaggcccaucguagauauaaaugugaaagauuauagcauuguuuccaguuaugugugcucagggcuuguuggcgacacacccagaaaaaaugacagauucagcaguagcuauugccggaauccuaacaaugagaaagggaaucauggagugaaaggcugggccuuugacgauggaaaugacguguggaugggaagaacaauuggcgaggaguuacgcucagguuaugaaaccuucaaagucauuggugguugguccacaccuaacuccaaauugcagauaaauaggcaagucauaguugacagcaaaaauaggucagguuauucugguauuuucucuguugagggcaaaagcugcaucaauaggugcuuuuauguagaguugauaaggggaagggaacaggaaacuagagucugguggaccucaaacaguauuguuguguuuugugguaccucagguacauauggaacaggcucauggccugauggagcggacaucaaucucaugccuauauaa

SEQ ID NO: 52513 - RNA, 1410 nt, Artificial Sequence
  neuraminidase__InfluenzaA__AFG99251
augaauccaaaucaaaagauaauaacaauuggcucuguuucucucacuauugccacaauaugcuuucuuaugcaaauugccauccugguaacuacuguaacauugcauuucaagcaauaugagugcagcucccccccaaacaaccaaguaaugccgugugaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuugggcagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagauccagcaguagcuauugccggaauccuaacaaugagaaagggagucauggagugaaaggcugggccuuugacgauggaaaugacguguggaugggaagaacgaucggagaggaguuacgcucagguuaugaaaccuucaaagucauuggagguugguccacaccuaacuccaaauugcagauaaauaggcaagucauaguugacagcgguaauagguccgguuauucugguauuuucucuguugagggcaaaagcugcaucaaucggugcuuuuauguggaguugauaaggggaagggaacaggaaacuagagucugguggaccucaaacaguauuguuguguuuuguggcaccucagguacauauggaacaggcucauggccugauggggcggacaucaaucucaugccuauauaa

SEQ ID NO: 52514 - RNA, 1410 nt, Artificial Sequence
  neuraminidase__InfluenzaA__AFG99273
augaauccaaaucaaaagauaauaacaauuggcucuguuucucucaccauugccacaaugugcuuccuuaugcaaauugccauccugguaacuacuguaacacugcauuucaagcaauaugagugcagcucccccccaaacaaccaaguaaugccgugugaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuugggcagggaaccacacuaaacaacaggcauucaaaugacacaguacaugauagaaccccuuaucgaacccucuugaugaaugaauuggguguuccauuucauuugggaaccaagcaagugugcauagcaugguccagcucaaguugucacgauggaaaagcauggcugcauguuugugucacugggcaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagauccagcaguagcuauugccggaauccuaacaaugagaaagggagucauggggugaaaggcugggccuuugacgauggaaaugacguguggaugggaagaacgaucggcgaggaguuacgcucagguuaugaaaccuucaaagucauuggagguugguccacaccuaacuccaaauugcagauaaauaggcaagucauaguugacagcgguaauagguccgguuauucugguauuuucucuguugagggcaaaagcugcaucaaucggugcuuuuauguggaguugauaaggggaagggaacaggaaacuagagucugguggaccucaaacaguauuguuguguuuuguggcaccucagguacauauggaacaggcucauggccugauggggcggacaucaaucucaugccuauauaa

SEQ ID NO: 52515 - RNA, 1410 nt, Artificial Sequence
  neuraminidase__InfluenzaA__AFG99284
augaauccaaaucaaaagauaauaacaauuggcucuguuucucucaccauugcaacaauaugcuuccuuaugcaaauugccauccugguaacuacuguaacacugcauuucaagcaauaugagugcagcucccccccaagcaaucaaguaaugccgugugaaccaauaauaauagaaagaaacauaacaaagauaguguacuugacuaacaccaccauagagaaagagauaugccccaaacuaguggaauacagaaacuggucaaagccgcaauguaaaauuacaggauuugcaccuuuuucuaaggacaauucaauucggcuuuccgcugguggggacauuugggugacgagagaaccuuaugugucaugcgauccuagcaaguguuaucaauuugcacucgggcagggaaccacacuaaacaacaagcauucaaaugacacaauacaugauaggaccccuuaucgaacccuauuaaugaaugaguugggugucccauuccauuugggaaccaagcaagugugcauagcaugguccagcucaaguugucacgauggaaaagcauggcugcauguuugugucacuggacaugaugauaaugcaacugcuagcuucauuuacgaugggaggcuuguagacaguauugguucaugguccaaaaauauucucaggacccaggagucggagugcguuuguaucaaugggacuuguacaguaguaaugacugauggaagugcuucagagagagcugauacuaaaauacuauucauugaagaggggaaaaucguucauauuagcccauugucaggaagugcucagcauguagaggaguguucuuguuauccucgguauccuggugucagaugugucugcagagacaauuggaaaggcuccaauaggcccaucguagauauaaaugugaaagauuauagcauuguuuccaguuaugugugcucagggcuuguuggcgacacacccagaaaaaacgacagauccagcaguagcuauugccggaauccuaacaaugagaaagggagucauggagugaaaggcugggccuuugacgauggaaaugacguguggauggggagaacgauuggcgaggaguuacgcucagguuaugaaaccuucaaagucauuggugguugguccacaccuaacuccaaauugcagauaaauaggcaagucauaguugacagcaaaaauaggucagguuauucugguauuuucucuguugagggcaaaagcugcaucaauaggugcuuuuauguggaguugauaaggggaagggaacaggaaacuagagucugguggaccucaaacaguauuguuguguuuuguggcaccucagguacauauggaacaggcucauggccugauggagcggacaucaaucucaugccuauauaa

SEQ ID NO: 52516 - RNA, 1410 nt, Artificial Sequence
  neuraminidase__InfluenzaA__AFG99295
augaauccaaaucaaaagauaauaacaauuggcucuguuucucucaccauugccacaauaugcuuucuuaugcaaauugccauccugguaacuacuguaacauugcauuucaagcaauaugagugcagcucccccccgaacaaccaaguaaugccgugugaaccaacaauaauagaaagaaacauaaccgagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccugacaaguguuaucaauuugcacuugggcagggaaccacacuaaacaacaggcauucaaaugacacaguacaugauaggaccccuuaucgaacccucuugaugaaugaguuggguguuccauuucauuugggaaccaagcaggugugcauagcaugguccagcucaaguugucacgauggaaaagcauggcugcauguuugugucacugggcaugauaaaaaugcaacugcuagcuucauuuacaaugggcggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaagaucguucauauuagcccauugucagggagugcucagcauguagaggagugcuccuguuauccucgauauccuggugucagaugugucugcagagacaacuggaaaggcuccaauaggcccaucguagauauaaaugugaaagauuauagcauuauuuccaguuaugugugcucagggcuuguuggagacacacccagaaaaaacgacagauccagcaguagcuauugccagaauccuaacaaugagaaagggagccauggagugaaaggcugggccuuugaugauggaaaugacguguggaugggaagaacgaucggcgaggaguuacgcucagguuaugaaaccuucaaagucauuggagguugguccacaccuaacuccaaauugcagauaaauaggcaagucauaguugacagcgguaauagguccgguuauucugguauuuucucuguugagggcaaaagcugcaucaaucggugcuuuuauguggaguugauaaggggaaggaaacaggaaacuagagucugguggaccucaaacaguauuguuguguuuuguggcaccucagguacauauggaacaggcucauggccugauggggcggacaucaaucucaugccuauauaa

SEQ ID NO: 52517 - RNA, 1410 nt, Artificial Sequence
  neuraminidase__InfluenzaA__AFG99317
augaauccaaaucaaaagauaauaacaauuggcucuguuucucucaccauugccacaauaugcuuccuuaugcaaauugccauccugguaacuacuguaacauugcauuucaagcaauaugagugcagcucccccccaaacaaccaaguaaugccgugugaaccaacaauaauagaaagaaacauaacagagauaguguauuugacuaauaccaccauagagaaagagauaugucccaaacuaguagaauacagaaauuggucaaagccgcaauguaauauuacaggauuugcaccuuuuucuaaggacaauucaauucggcuuucugcugguggagacauuugggugacaagagaaccuuaugugucaugcgauccuggcaaguguuaucaauuugcacuugggcagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggaggcuuguagacaguauugguucaugguccaaaaauauucucaggacccaggagucggaaugcguuuguaucaaugggacuuguacaguaguaaugacugauggaagugcuucagaaagagcugauacuaaaauacuauucauugaagaggggaaaaucguucacauuagcccauugucaggaagugcucagcauguagaggaguguuccuguuauccucgauauccuggugucagaugugucugcagagacaacuggaaaggcuccaauaggcccaucguagauauaaaugugaaagauuauagcauuguuuccaguuaugugugcucagggcuugucggagacacacccagaaaaaacgacagauccagcaguagcuauugccggaauccuaacaaugagaaagggagucauggagugaaaggcugggccuuugacgauggaaaugacguguggaugggaagaacgaucgacgaggaguuacgcucagguuaugaaaccuucaaagucauuggagguugguccacaccuaacuccaaauugcagauaaauaggcaagucauaguugacagcgguaauaggucugguuauucugguauuuucucuguugagggcaaaagcugcaucaaucggugcuuuuauguggaguugauaaggggaaggaaacaggaaacuagagucugguggaccucaaacaguauuguuguguuuuguggcaccucagguacauauggaacaggcucauggccugauggggcggacaucaaucucaugccuauauaa

SEQ ID NO: 52518 - RNA, 1410 nt, Artificial Sequence
  neuraminidase__InfluenzaA__AFG99328
augaauccaaaucaaaagauaauaacaauuggcucuguuucucucacccuugccacaauaugcuuccuuaugcaaauugccauccugguaacuacuguaacauugcauuucaagcaauaugagugcagcucccccccaaacaaccaaguaaugccgugcgaaccaacaauaauagaaagaaacauaacagagauaguguauuugaccaacaccaccauagagaaagagauaugccccaaacuaguagaauacagaaauuggucaaagccgcaauguaaaauuacaggauuugcaccuuuuucuaaggacaauucaauucggcuuuccgcugguggagacauuuggguaacaagagaaccuuaugugucaugcgauccuagcaaguguuaucaauuugcacuugggcagggaaccacacuaaacaacaggcauucaaaugacacaguacaugauaggaccccuuaucgaacucucuugaugaaugaguuggguguuccauuucauuugggaaccaggcaagugugcauggcaugguccagcucaagcugccacgauggaaaagcauggcugcauguuugugucacugggcaugaugaaaaugcaacugcuagcuucauuuacgaugggaggcuuguagacaguauugguucaugguccaaaaauguccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaaaugcucagcauguggaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagauccagcaguagcuauugccggaauccuaauaaugagaaagggagucauggagugaaaggcugggccuuugacgauggaaaugacguguggaugggaagaacgaucggcgaggaguuacgcucagguuaugaaaccuucaaagucauuggagguugguccacaccuaacuccaaauugcagauaaauaggcaagucauaguugacagcgguaauagguccgguuauucugguauuuucucuguugagggcaaaagcugcaucaaucggugcuuuuauguggaguugauaaggggaaggaaacaggaaacuagagucugguggaccucaaacaguauuguuguguuuugcggcaccucagguacauauggaacaggcucauggccugauggggcggacaucaaucucaugccuauauaa

SEQ ID NO: 52519 - RNA, 1410 nt, Artificial Sequence
  neuraminidase__InfluenzaA__AFG99350
augaauccaaaucaaaagauaauaacaauuggcucuguuucucucacccuugccacaauaugcuuccuuaugcaaauugccauccugguaacuacuguaacauugcauuucaagcaauaugagugcagcucccccccaaacaaccaaguaaugccgugcgaaccaacaauaauagaaagaaacauaacagagauaguguauuugaccaacaccaccauagagaaagagauaugccccaaacuaguagaauacagaaauuggucaaagccgcaauguaaaauuacaggauuugcaccuuuuucuaaggacaauucaauucggcuuuccgcugguggagacauuuggguaacaagagaaccuuaugugucaugcgauccuagcaaguguuaucaauuugcacuugggcagggaaccacacuaaacaacaggcauucaaaugacacaguacaugauaggaccccuuaucgaacucucuugaugaaugaguuggguguuccauuucauuugggaaccaggcaagugugcauggcaugguccagcucaagcugccacgauggaaaagcauggcugcauguuugugucacugggcaugaugaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguggaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagauccagcaguagcuauugccggaauccuaauaaugagaaagggagucauggagugaaaggcugggccuuugacgauggaaaugacguguggaugggaagaacgaucggcgaggaguuacgcucagguuaugaaaccuucaaagucauuggagguugguccacaccuaacuccaaauugcagauaaauaggcaagucauaguugacagcgguaauagguccgguuauucugguauuuucucuguugagggcaaaagcugcaucaaucggugcuuuuauguggaguugauaaggggaaggaaacaggaaacuagagucugguggaccucaaacaguauuguuguguuuugcggcaccucagguacauauggaacaggcucauggccugauggggcggacaucaaucucaugccuauauaa

SEQ ID NO: 52520 - RNA, 1410 nt, Artificial Sequence
  neuraminidase__InfluenzaA__AFG99361
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaaaaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcacucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52521 - RNA, 1410 nt, Artificial Sequence
  neuraminidase__InfluenzaA__AFG99383
augaauccaaaucaaaagauaauaacaauuggcucuguuucucucaccauugccacaauaugcuuccuuaugcaaauugccauccugguaacuacuguaacauugcauuucaagcaauaugagugcagcucccccccaaacaaccaaguaaugccgugugaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggaggcuuguagauaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggagguugguccacaccuaacuccaaauugcagauaaauaggcaagucauaguugacagcgguaauagguccgguuauucugguauuuucucuguugagggcaaaagcugcaucaaucggugcuuuuauguggaguugauaaggggaaggaaacaggaaacuaaagucugguggaccucaaacaguauuguuguguuuuguggcaccucagguacauauggaacaggcucauggccugauggggcggacaucaaucucaugccuauauaa

SEQ ID NO: 52522 - RNA, 1410 nt, Artificial Sequence; identical to SEQ ID NO: 52521
  neuraminidase__InfluenzaA__AFG99394

SEQ ID NO: 52523 - RNA, 1410 nt, Artificial Sequence
  neuraminidase__InfluenzaA__AFG99405
augaauccaaaucaaaagauaauaacaauuggcucuguuucucucaccauugccacaauaugcuuccuuaugcaaauugccauccugguaacuacuguaacauugcauuucaagcaauaugagugcagcucccccccaaacaaccaaguaaugccgugugaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuugggcagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuauuuccaguuaugugugcucagggcuuguuggagacacacccagaaaaaacgacagauccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggagguugguccacaccuaacuccaaauugcagauaaauaggcaagucauaguugacagcgguaauagguccgguuauucugguauuuucucuguugagggcaaaagcugcaucaaucggugcuuuuauguggaguugauaaggggaagggaacaggaaacuagagucugguggaccucaaacaguauuguuguguuuugugguaccucagguacauauggaacaggcucauggccugauggggcggacaucaaucucaugccuauauaa

SEQ ID NO: 52524 - RNA, 1410 nt, Artificial Sequence
  neuraminidase__InfluenzaA__AFG99416
augaauccaaaucaaaagauaauaacaauuggcucuguuucucucaccauugccacaauaugcuuccuuaugcaaauugccauccugguaacuacuguaacauugcauuucaagcaauaugagugcagcucccccccaaacaaccaaguaaugccgugugaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuaugaugggaggcuuguagauaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucauucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggagguugguccacaccuaacuccaaauugcagauaaauaggcaagucauaguugacggcgguaauagguccgguuauucugguauuuucucuguugagggcaaaagcugcaucaaucggugcuuuuauguggaguugauaaggggaaggaaacaggaaacuaaagucugguggaccucaaacaguauuguuguguuuuguggcaccucagguacauauggaacaggcucauggccugauggggcggacaucaaucucaugccuauauaa

SEQ ID NO: 52525 - RNA, 1410 nt, Artificial Sequence
  neuraminidase__InfluenzaA__AFG99427
augaauccaaaucaaaagauaauaacaauuggcucuguuucucucaccauugccacaauaugcuuccuuaugcaaauugccauccugguaacuacuguaacauugcauuucaagcaauaugagugcagcucccccccaaacaaccaaguaaugccgugugaaccaacaauaauagaaagaaacauaacagagauaguguauuugacuaacaccaccauagagaaagagguaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggaggcuuguagauaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucauucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggagguugguccacaccuaacuccaaauugcagauaaauaggcaagucauaguugacagcgguaauagguccgguuauucugguauuuucucuguugagggcaaaagcugcaucaaucggugcuuuuauguggaguugauaaggggaaggaaacaggaaacuaaagucugguggaccucaaacaguauuguuguguuuuguggcaccucagguacauauggaacaggcucauggccugauggggcggacaucaaucucaugccuauauaa

SEQ ID NO: 52526 - RNA, 1410 nt, Artificial Sequence
  neuraminidase__InfluenzaA__AFG99438
augaauccaaaucaaaagauaauaacaauuggcucuguuucucucaccauugccacaauaugcuuccuuaugcaaauugccauccugguaacuacuguaacauugcauuucaggcaauaugagugcagcucccccccaaacaaccaaguaaugccgugcgaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucgugcgauccuggcaaguguuaucaauuugcacuugggcagggaaccacacuaaacaacaggcauucaaaugacacaguacaugauaggaccccuuaucgaacccucuugaugaaugaguuggguguuccauuucauuugggaaccaagcaagugugcauggcaugguccagcucaagcugucacgauggaaaagcauggcugcauguuugugucacugggcaugaugaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauugucuccaguuaugugugcucagggcuuguuggagacacacccagaaaaaacgacagauccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggagguugguccacaccuaacuccaaauugcagauaaauaggcaagucauaguugacagcgguaauagguccgguuauucugguauuuucucuguugagggcaaaagcugcaucaaucggugcuuuuauguggaguugauaaggggaaggaaacaggaaacuagagucugguggaccucaaacaguauuguuguguuuuguggcaccucagguacauauggaacaggcucauggccugauggggcggacaucaaucucaugccuauauaa

SEQ ID NO: 52527 - RNA, 1410 nt, Artificial Sequence
  neuraminidase__InfluenzaA__AFG99449
augaauccaaaucaaaagauaauaacaauuggcucuguuucucucaccauugccacaauaugcuuccuuaugcaaauugccauccugguaacuacuguaacauugcauuucaggcaauaugagugcagcucccccccaaacaaccaaguaaugccgugcgaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuugggcagggaaccacacuaaacaacaggcauucaaaugacacaguacaugauaggaccccuuaucgaacccucuugaugaaugaguuggguguuccauuucauuugggaaccaagcaagugugcauggcaugguccagcucaagcugucacgaugggaaagcauggcugcauguuugugucacugggcaugaugaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauugucuccaguuaugugugcucagggcuuguuggagacacacccagaaaaaacgacagauccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggagguugguccacaccuaacuccaaauugcagauaaauaggcaagucauaguugacagcgguaauagguccgguuauucugguauuuucucuguugagggcaaaaacugcaucaaucggugcuuuuauguggaguugauaaggggaaggaaacaggaaacuagagucugguggaccucaaacaguauuguuguguuuuguggcaccucagguacauauggaacaggcucauggccugauggggcggacaucaaucucaugccuauauaa

SEQ ID NO: 52528 - RNA, 1410 nt, Artificial Sequence
  neuraminidase__InfluenzaA__AFG99471
augaauccaaaucaaaagauaauaacaauuggcucuguuucucucauccuugccacaauaugcuuccuuaugcaaauugccauccugguaacuacuguaacauugcauuucaagcaauaugagugcagcucccccccaaacaaccaaguaaugccgugcgaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuuggguaacaagagaaccuuaugugucaugcgauccuggcaaguguuaucaauuugcacuugggcagggaaccacacuaaacaacaggcauucaaaugacacaguacaugauaggaacccuuaucgaacucucuugaugaaugaguuggguguuccauuucauuugggaaccaggcaagugugcauggcaugguccagcucaagcugccacgauggaaaagcauggcugcauguuugugucacugggcaugaugaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguggaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagauccagcaguagcuauugccggaauccuaauaaugagaaagggagucauggagugaaagguugggccuuugacgauggaaaugacguguggaugggaagaacgaucggcgaggaguuacgcucagguuaugaaaccuucaaagucauuggagguugguccacaccuaacuccaaauugcagauaaauaggcaagucauaguugacagcgguaauagguccgguuauucugguauuuucucuguugagggcaaaagcugcaucaaucggugcuuuuauguggaguugauaaggggaaggaaacaggaaacuagagucugguggaccucaaacaguauuguuguguuuugcggcaccucagguacauauggaacaggcucauggccugauggggcggacaucaaucucaugccuauauaa

SEQ ID NO: 52529 - RNA, 1410 nt, Artificial Sequence
  neuraminidase__InfluenzaA__AFG99482
augaauccaaaucaaaagauaauaacaauuggcucuguuucucucaccauugccacaauaugcuuccuuaugcaaauugccauccugguaacuacuguaacauugcauuucaagcaauaugagugcaacucccccccaaacaaccaaguaaugccgugugaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccggaauccuaacaaugagaaagggagucauggagugaaaggcugggccuuugacgauggaaaugacguguggaugggaagaacgauuggcgaggaguuacgcucagguuaugaaaccuucaaagucauuggaggcugguccacaccuaacuccaaauugcagauaaauaggcaagucauaguugacagagguaauagguccgguuauucugguauuuucucuguugaaggcaaaaacugcaucaaucggugcuuuuauguggaguugauaaggggaaggaaacaggaaacuaaagucugguggaccucaaacaguauuguuguguuuuguggcaccucagguacauauggaacaggcucauggccugauggggcggacaucaaucucaugucuauauaa

SEQ ID NO: 52530 - RNA, 1410 nt, Artificial Sequence
  neuraminidase__InfluenzaA__AFG99493
augaauccaaaucaaaagauaauaacaauuggcucuguuucucucaccauugccacaauaugcuuccuuaugcaaauugccauccugguaacuacuguaacauugcauuucaagcaauaugagugcaacucccccccaaacaaccaaguaaugccgugugaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccggaauccuaacaaugagaaagggagucauggagugaaaggcugggccuuugacgauggaaaugacguguggaugggaagaacgauuggcgaggaguuacgcucagguuaugaaaccuucaaagucauuggaggcugguccacaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacuaaagucugguggaccucaaacaguauuguuguguuuuguggcaccucagguacauauggaacaggcucauggccugauggggcggacaucaaucucaugccuauauaa

SEQ ID NO: 52531 - RNA, 1410 nt, Artificial Sequence
  neuraminidase__InfluenzaA__AFG99504
augaauccaaaucaaaagauaauaacaauuggcucuguuucucucaccauugccacaauaugcuuccuuaugcaaauugccauccugguaacuacuguaacauugcauuucaagcaauaugagugcagcucccccccaaacaaccaaguaaugccgugugaaccaacaauaauagaaagaaacauaacagagauaguguauuugacuaacaccaccauagagaaagagauaugccccaaacuaguagaauacagaaauuggucaaagccgcaauguaagauuacaggauuugcaccuuuuucuaaggacaauucaauucggcuuuccgcugguggagauauuugggugacaagagaaccuuaugugucaugcgauccuggcaaguguuaucaauuugcacuugggcagggaaccacccuaaacaacaggcauucaaaugacacaguacaugauaggaccccuuaucgaacccucuugaugaaugaguuggguguuccauuucauuugggaaccaagcaaguaugcauagcaugguccagcucaaguugucacgauggaaaagcauggcugcauguuugugucacugggcaugaugaaaaugcaacugcuagcuucauuuacgaugggaggcuuguagacaguauugguucaugguccaaaaacauccucaggacccaggagucugaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuugucggagacacacccagaaaaaacgacagauccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggagguugguccacaccuaacuccaaauugcagauaaauaggcaagucauaguugacagcgguaauagguccgguuauucugguauuuucucuguugagggcaaaagcugcaucaaucggugcuuuuauguggaguugauaaggggaaggaaacaggaaacuagagucugguggaccucaaacaguauuguuguguuuuguggcaccucagguacauauggaacaggcucauggccugauggggcggacaucaaucucaugccuauauaa

SEQ ID NO: 52532 - RNA, 1410 nt, Artificial Sequence
  neuraminidase__InfluenzaA__AFG99515
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguauuugacuaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaauuguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggaggcugguccacaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52533 - RNA, 1410 nt, Artificial Sequence
  neuraminidase__InfluenzaA__AFG99526
augaauccaaaucaaaagauaauaacaauuggcucuguuucucucacccuugccacaauaugcuuccuuaugcaaauugccauccugguaaccacuguaacauugcauuucaagcaauaugagugcagcucccccccaaacaaccaaguaaugccgugcgaaccaacaauaauagaaagaaacauaacagagauaguguauuugacuaacaccacuauagagaaagagguaugccccaaacuaguagaauacagaaauuggucaaagccgcaauguaaaauuacaggauuugcaccuuuuucuaaggacaauucaauucggcuuuccgcugguggagacauuuggguaacaagagaaccuuaugugucaugcgauccuggcaaguguuaucaauuugcacuugggcagggaaccacacuaaacaacaggcauucaaaugacacaguacaugauaggaccccuuaucgaacucucuugaugaaugaguuggguguuccauuucauuugggaaccaggcaagugugcauggcaugguccagcucaagcugccacgauggaaaagcauggcugcauguuugugucacugggcaugaugaaaaugcaacugcuagcuucauuuacgaugggaggcuaguagacaguauugguucaugguccaaaaauauccucaggacccaggagucggaaugcguuuguaucaaugggacuuguacaguaguaaugacugauggaagugcuucaggaagagcugauacuaaaauacuauucauugaagaggggaaaaucguucauauuagcccauugucaggaagugcucagcauguggaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagauccagcaguagcuauugccggaauccuaauaaugagaaagggagucauggagugaaaggcugggccuuugacgauggaaaugacguguggaugggaagaacgaucggcgaggaguuacgcucagguuaugaaaccuucaaagucauuggagguugguccacaccuaacuccaaauugcagauaaauaggcaagucauaguugacagcgguaauagguccgguuauucugguauuuucucuguugagggcaaaagcugcaucaaucggugcuuuuauguggaguugauaaggggaaggaaacaggaaacuagagucugguggaccucaaacaguauuguuguguuuugcggcaccucagguacauauggaacaggcucauggccugauggggcggacaucaaucucaugccuauauaa

SEQ ID NO: 52534 - RNA, 1410 nt, Artificial Sequence; identical to SEQ ID NO: 52435
  neuraminidase__InfluenzaA__AFG99537

SEQ ID NO: 52535 - RNA, 1410 nt, Artificial Sequence
  neuraminidase__InfluenzaA__AFG99548
augaauccaaaucaaaagauaauaacaauuggcucuguuucucucaccauugccacaauaugcuuccuuaugcaaauugccauccugguaacuacuguaacauugcauuucaagcaauaugagugcaacucccccccaaacaaccaaguaaugccgugugagccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuaggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggagacuuguagauaguauuguuucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggaggcugguccacaccuaacuccaaauugcagacaaauaggcaagucauaguugacagagguaauagguccgguuauucugguauuuucucuguugaaggcaaaagcugcaucaaucggugcuuuuauguagaauugauaaggggaaggaaacaggaaacuaaagucugguggaccucaaacaguauuguuguguuuuguggcaccucagguacauauggaacaggcucauggccugauggggcggacaucaaucucaugccuauauaa

SEQ ID NO: 52536 - RNA, 1410 nt, Artificial Sequence; identical to SEQ ID NO: 52435
  neuraminidase__InfluenzaA__AFG99559

SEQ ID NO: 52537 - RNA, 1410 nt, Artificial Sequence
  neuraminidase__InfluenzaA__AFG99570
augaauccaaaucaaaagauaauaacaauuggcucuguuucucucaccauugccacaauaugcuuccuuaugcaaauugccauccugguaacuacuguaacauugcauuucaagcaauaugagugcaacucccccccaaacaaccaaguaaugccgugugagccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuaggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggagacuuguagauaguauuguuucaugguccaaaaauauccucaggacccaggagucggaaugcguuuguaucaauggaacuuguacaguaguaaugacugauggaagugcuucagaaagagcugauacuaaaauacuauucauugaagaggggaaaauuguucauauuagcccauugucaggaagugcucagcauguagaggagugcuccuguuauccucgauauccuggggucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggaggcugguccacaccuaacuccaaauugcagacaaauaggcaagucauaguugacagagguaauagguccgguuauucugguauuuucucuguugaaggcaaaagcugcaucaaucggugcuuuuauguagaauugauaaggggaaggaaacaggaaacuaaagucugguggaccucaaacaguauuguuguguuuuguggcaccucagguacauauggaacaggcucauggccugauggggcggacaucaaucucaugccuauauaa

SEQ ID NO: 52538 - RNA, 1410 nt, Artificial Sequence; identical to SEQ ID NO: 52535
  neuraminidase__InfluenzaA__AFG99581

SEQ ID NO: 52539 - RNA, 1410 nt, Artificial Sequence
  neuraminidase__InfluenzaA__AFG99592
augaauccaaaucaaaagauaauaacaauuggcucuguuucucucaccauugccacaacaugcuuccuuaugcaaauugccauccugguaacuacuguaacauugcauuucaagcaauaugagugcaacucccccccaaacaaccaaguaaugccgugugagccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuaggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggagacuuguagauaguauuguuucaugguccaaaaauauccucaggacccaggagucggaaugcguuuguaucaauggaacuuguacaguaguaaugacugauggaagugcuucagaaagagcugauacuaaaauacuauucauugaagaggggaaaauuguucauauuagcccauugucaggaagugcucagcauguagaggagugcuccuguuauccucgauauccuggggucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggaggcugguccacaccuaacuccaaauugcagacaaauaggcaagucauaguugacagagguaauagguccgguuauucugguauuuucucuguugaaggcaaaagcugcaucaaucggugcuuuuauguagaauugauaaggggaaggaaacaggaaacuaaagucugguggaccucaaacaguauuguuguguuuuguggcaccucagguacauauggaacaggcucauggccugauggggcggacaucaaucucaugccuauauaa

SEQ ID NO: 52540 - RNA, 1410 nt, Artificial Sequence
  neuraminidase__InfluenzaA__AFG99603
augaauccaaaucaaaagauaauaacaauuggcucuguuucucucaccauugccacaauaugcuuccuuaugcaaauugccauccugguaacuacuguaacauugcauuucaagcaauaugagugcaacucccccccaaacaaccaaguaaugccgugugagccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuaggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggagacuuguagauaguauuguuucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggaggcugguccacaccuaacuccaaauugcagacaaauaggcaagucauaguugacagagguaauagguccgguuauucugguauuuucucuguugaaggcaaaagcugcaucaaucggugcuuuuauguagaauugauaaggggaaggaaacaggaaacuaaaguaugguggaccucaaacaguauuguuguguuuuguggcaccucagguacauauggaacaggcucauggccugauggggcggacaucaaucucaugccuauauaa

SEQ ID NO: 52541 - RNA, 1410 nt, Artificial Sequence; identical to SEQ ID NO: 52535
  neuraminidase__InfluenzaA__AFG99614

SEQ ID NO: 52542 - RNA, 1410 nt, Artificial Sequence; identical to SEQ ID NO: 52535
  neuraminidase__InfluenzaA__AFG99625

SEQ ID NO: 52543 - RNA, 1410 nt, Artificial Sequence
  neuraminidase__InfluenzaA__AFG99636
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguauuugacuaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuaggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggagacuuguagauaguauuguuucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccggaauccuaacaaugagaaagggagucauggagugaaaggcugggccuuugacgauggaaaugacguguggaugggaagaacgaucggcgaggauuuacgcucagguuaugaaaccuucaaagucauuggaggcugguccacaccuaacuccaaauugcagacaaauaggcaagucauaguugacagagguaauagguccgguuauucugguauuuucucuguugaaggcaaaagcugcaucaaucggugcuuuuauguagaauugauaaggggaaggaaacaggaaacuaaagucugguggaccucaaacaguauuguuguguuuuguggcaccucagguacauauggaacaggcucauggccugauggggcggacaucaaucucaugccuauauaa

SEQ ID NO: 52544 - RNA, 1410 nt, Artificial Sequence
  neuraminidase__InfluenzaA__AFG99658
augaauccaaaucaaaagauaauaacaauuggcucuguuucucucacuauugccacaauaugcuuccuuaugcaaauuaccauccugguaacuacuguaacauugcauuucaagcaauaugagugcaacucccccccaaacaaccaaguaaugcugugugaaccaacaauaauagaaagaaacauaacagagauaguguauuugacuaacaccaccauagagaaagagauaugccccaaacuaguagaauacagaaauuggucaaagccgcaauguaaaaucacaggauuugcaccuuuuucuaaggacaauucaauucggcuuuccgcugguggagacauuugggugacaagagaaccuuaugugucaugcgauccuggcaaguguuaucaauuugcacuuggacagggaaccacacuaaacaacaggcauucaaaugacacaguacaugauaggaccccuuaucgaacccucuugaugaaugaguuggguguuccauuucauuugggaaccaagcaagugugcauagcaugguccaguucaaguugucacgauggaaaagcauggcugcauguuugugucacugggcaugaugaaaaugcaacugcuagcuucauuuacgaugggaggcuuguagauaguauuaguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauacccuggugucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccggaauccuaacaaugagaaaggaagucauggagugaaaggcugggccuuugacgauggaaaugacguguggaugggaagaacgaucagcgaggaguuacgcucagguuaugaaaccuucaaagucauuggaggcugguccacaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaaauaaagucugguggaccucaaacaguauuguuguguuuuguggcaccucagguacauauggaacaggcucauggccugauggggcggacaucaaucucaugccuauauaa

SEQ ID NO: 52545 - RNA, 1410 nt, Artificial Sequence
  neuraminidase__InfluenzaA__AFG99680
augaauccaaaucaaaagauaauaacaauuggcucuguuucucucacuauugccacaauaugcuuccuuaugcaaauugccauccugguaacuacuguaacauugcauuucaagcaauaugagugcagcucccccccaaacaaccaaguaauucuaugucaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuagcaaauguuaucaauuugcacuuggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggaggcuuguagauaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaagucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccggaauccuaacaaugagaaagggagucauggagugaaaggcugggccuuugacgauggaaaugacguguggaugggaagaacgaucagcgaggaguuacgcucagguuaugaaaccuucaaagucauuggagguugguccacaccuaauuccaaauugcagauaaauaggcaagucauaguugacagcgguaauagguccgguuauucugguauuuucucuguugaaggcaaaagcugcaucaaucggugcuuuuauguggaguugauaaggggaaggaaacaggaaacuaaagucugguggaccucaaacaguauuguuguguuuuguggcaccucagguacauauggaacaggcucauggccugauggggcggacaucaaucucaugccuauauaa

SEQ ID NO: 52546 - RNA, 1410 nt, Artificial Sequence
  neuraminidase__InfluenzaA__AFG99691
augaauccaaaucaaaagauaauaacaauuggcucuguuucucucaccauugccacaauaugcuuccuuaugcaaauugccauccugguaacuacuguaacauugcauuucaagcaauaugagugcaacucccccccaaacaaccaaguaaugccgugugagccaacaauaauagaaagaaacacaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuaggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggagacuuguagauaguauuguuucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggaggcugguccacaccuaacuccaaauugcagacaaauaggcaagucauaguugacagagguaauagguccgguuauucugguauuuucucuguugaaggcaaaagcugcaucaaucggugcuuuuauguagaauugauaaggggaaggaaacaggaaacuaaagucugguggaccucaaacaguauuguuguguuuuguggcaccucagguacauauggaacaggcucauggccugauggggcggacaucaaucucaugccuauauaa

SEQ ID NO: 52547 - RNA, 1410 nt, Artificial Sequence; identical to SEQ ID NO: 52435
  neuraminidase__InfluenzaA__AFG99704

SEQ ID NO: 52548 - RNA, 1410 nt, Artificial Sequence; identical to SEQ ID NO: 52435
  neuraminidase__InfluenzaA__AFG99715

SEQ ID NO: 52549 - RNA, 1410 nt, Artificial Sequence; identical to SEQ ID NO: 52435
  neuraminidase__InfluenzaA__AFG99726

SEQ ID NO: 52550 - RNA, 1410 nt, Artificial Sequence
  neuraminidase__InfluenzaA__AFG99737
augaauccaaaucaaaagauaauaacaauuggcucuguuucucucacuauugccacaauaugcuuccuuaugcaaauuaccauccugguaacuacuguaacauugcauuucaagcaauaugagugcaacucccccccaaacaaccaaguaaugcugugugaaccaacaauaauagaaagaaacauaacagagauaguguauuugacuaacaccaccauagagaaagagauaugccccaaacuaguagaauacagaaauuggucaaagccgcaauguaaaaucacaggauuugcaccuuuuucuaaggacaauucaauucggcuuuccgcugguggagacauuugggugacaagagaaccuuaugugucaugcgauccuggcaaguguuaucaauuugcacuuggacagggaaccacacuaaacaacaggcauucaaaugacacaguacaugauaggaccccuuaucgaacccucuugaugaaugaguuggguguuccauuucauuugggaaccaagcaagugugcauagcaugguccaguucaaguugucacgauggaaaagcauggcugcauguuugugucacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauacccuggugucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccggaauccuaacaaugagaaaggaagucauggagugaaaggcugggccuuugacgauggaaaugacguguggaugggaagaacgaucagcgaggaguuacgcucagguuaugaaaccuucaaagucauuggaggcugguccacaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaaauaaagucugguggaccucaaacaguauuguuguguuuuguggcaccucagguacauauggaacaggcucauggccugauggggcggacaucaaucucaugccuauauaa

SEQ ID NO: 52551 - RNA, 1410 nt, Artificial Sequence
  neuraminidase__InfluenzaA__AFG99748
augaauccaaaucaaaagauaauaacaauuggcucuguuucucucacuauugccacaauaugcuuccuuaugcaaauugccauccugguaacuacuguaacauugcauuucaagcaauaugauugcaacucccccccaaacaaccaagcaaugcugugugaaccaacaauaauagaaagaaacauaacagagauaguguauuugacuaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggaggcugguccacaccuaacuccaaauugcagauaaauaggcaagucauaguugacagagguaauagguccgguuauucugguauuuucucuguugaaggcaaaagcugcaccaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52552 - RNA, 1410 nt, Artificial Sequence; identical to SEQ ID NO: 52435
  neuraminidase__InfluenzaA__AFG99759

SEQ ID NO: 52553 - RNA, 1410 nt, Artificial Sequence
  neuraminidase__InfluenzaA__AFG99770
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaauaaugcugugugaaccaacaauaauagaaagaaacauaacagagauaguguauuugacuaacaccaccauagagagagaaauaugccccaaacuaguagaauacagaaauuggucaaagccgcaauguaaaauuacaggauuugcaccuuuuucuaaagacaauucaauucggcuuuccgcugguggagacauuugggugacaagagaaccuuaugugucaugcgauccuggcaaguguuaucaauuugcacuuggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggaggcugguccacaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52554 - RNA, 1410 nt, Artificial Sequence
  neuraminidase__InfluenzaA__AFG99781
augaauccaaaucaaaagauaauaacaauuggcucuguuucucucaccauugccacaauaugcuuccuuaugcaaauugccauccugguaacuacuguaacauugcauuucaagcaauaugagugcagcucccccccaaacaaccagguaaugcuaugucaaccaacaauaauagaaagaaacauaacagagauaguguauuugacuaacaccaccauagaaaaagagauaugccccaaacuaguagaauacagaaauuggucaaagccgcaaugcaaaauuacaggauuugcaccuuuuucuaaggacaauucaauccggcuuuccgcugguggagacauuugggugacaagagaaccuuaugugucaugcgauccuggcaaguguuaucaauuugcacuuggacagggaaccacacuaaacaacaggcauucaaaugacacaguacaugauaggaccccuuaucgaacccucuugaugaaugaauuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggaggcuuguagauaguauuggaucaugguccaaaaauauccucaggacccaggagucggaaugcguuuguaucaaugggacuuguacaguaguaaugacugauggaagugcuucaaaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgauagcuccagcaguagcuauugccggaauccuaacaaugagaaagggagucauggagugaaaggcugggccuuugacgauggaaaugacguguggaugggaagaacgaucagcgaggaguuacgcucagguuaugaaaccuucaaagucauuggagguugguccacaccuaauuccaaauuacagacaaauaggcaagucauaguugacagcgguaauagguccgguuauucugguauuuucucuguugaaggcaaaagcugcaucaaucggugcuuuuauguggaguugauaaggggaaggaaacaggaaacuaaagucugguggaccucaaacaguauuguuguguuuuguggcaccucagguacauauggaacaggcucauggccugauggggcggacaucaaucucaugccuauauaa

SEQ ID NO: 52555 - RNA, 1410 nt, Artificial Sequence; identical to SEQ ID NO: 52435
  neuraminidase__InfluenzaA__AFG99792

SEQ ID NO: 52556 - RNA, 1410 nt, Artificial Sequence
  neuraminidase__InfluenzaA__AFG99803
augaauccaaaucaaaagauaauaacaauuggcucuguuucucucacuauugccacaauaugcuuccuuaugcaaauuaccauccugguaacuacuguaacauugcauuucaagcaauaugagugcaacucccccccaaacaaccaaguaaugcugugugaaccaacaauaauagaaagaaacauaacagagauaguguauuugacuaacaccaccauagagaaagagauaugccccaaacuaguagaauacagaaauuggucaaagccgcaauguaaaaucacaggauuugcaccuuuuucuaaggacaauucaauucggcuuuccgcugguggagacauuugggugacaagagaaccuuaugugucaugcgauccuggcaaguguuaucaauuugcacuuggacagggaaccacacuaaacaacaggcauucaaaugacacaguacaugauaggaccccuuaucgaacccucuugaugaaugaguuggguguuccauuucauuugggaaccaagcaagugugcauagcaugguccaguucaaguugucacgauggaaaagcauggcugcauguuugugucacugggcaugaugaaaaugcaacugcuagcuucauuuacgaugggaggcuuguagauaguauugguucaugguccaaaaauauccucaggacccaggagucggaaugcguuuguauuaauggaacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauacccuggugucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccggaauccuaacaaugagaaaggaagucauggagugaaaggcugggccuuugacgauggaaaugacguguggaugggaagaacgaucagcgaggaguuacgcucagguuaugaaaccuucaaagucauuggaggcugguccacaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaaauaaagucugguggaccucaaacaguauuguuguguuuuguggcaccucagguacauauggaacaggcucauggccugauggggcggacaucaaucucaugccuauauaa

SEQ ID NO: 52557 - RNA, 1410 nt, Artificial Sequence; identical to SEQ ID NO: 52435
  neuraminidase__InfluenzaA__AFG99825

SEQ ID NO: 52558 - RNA, 1410 nt, Artificial Sequence
  neuraminidase__InfluenzaA__AFG99836
augaauccaaaucaaaagauaauaacaauuggcucuguuucucucaccauugccacaauaugcuuccuuaugcaaauugccauccugguaacuacuguaacauugcauuucaagcaauaugagugcaacucccccccaaacaaccaaguaaugccgugugaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuaggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggaggcuuguagauaguauuguuucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauagacccaucguagauauaaaugugaaagauuauagcauuguuuccaguuaugugugcucagggcuuguuggagacacacccagaaaaaacgacagcuccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggaggcugguccacaccuaacuccaaauugcagacaaauaggcaagucauaguugacagagguaauagguccgguuauucugguauuuucucuguugaaggcaaaagcugcaucaaucggugcuuuuauguagaauugauaaggggaaggaaacaggaaacuaaagucugguggaccucaaacaguauuguuguguuuuguggcacaucagguacauauggaacaggcucauggccugauggggcggacaucaaucucaugccuauauaa

SEQ ID NO: 52559 - RNA, 1410 nt, Artificial Sequence
  neuraminidase__InfluenzaA__AFG99847
augaauccaaaucaaaagauaauaacaauuggcucuguuucucucaccauugccacaauaugcuuccuuaugcaaauugccauccugguaacuacuguaacauugcauuucaagcaauaugagugcaacucccccccaaacaaccaaguaaugccgugugaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuucagcugguggagacauuugggugacaagagaaccuuaugugucaugcgauccuggcaaguguuaucaauuugcacuaggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggaggcuuguagauaguauuguuucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggaggcugguccacaccuaacuccaaauugcagacaaauaggcaagucauaguugacagagguaauagguccgguuauucugguauuuucucuguugaaggcaaaagcugcaucaaucggugcuuuuauguagaauugauaaggggaaggaaacaggaaacuaaagucugguggaccucaaacaguauuguuguguuuuguggcacaucagguacauauggaacaggcucauggccugauggggcggacaucaaucucaugccuauauaa

SEQ ID NO: 52560 - RNA, 1410 nt, Artificial Sequence; identical to SEQ ID NO: 52435
  neuraminidase__InfluenzaA__AFG99858

SEQ ID NO: 52561 - RNA, 1410 nt, Artificial Sequence; identical to SEQ ID NO: 52435
  neuraminidase__InfluenzaA__AFG99869

SEQ ID NO: 52562 - RNA, 1410 nt, Artificial Sequence; identical to SEQ ID NO: 52435
  neuraminidase__InfluenzaA__AFG99880

SEQ ID NO: 52563 - RNA, 1410 nt, Artificial Sequence
  neuraminidase__InfluenzaA__AFG99891
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguauuuuacuaacaccaccauagagaaagaaauaugccccaaacuagcagaauacagaaauuggucaaagccgcaauguaaaauuacaggauuugcaccuuuuucuaaggacaauucaauucggcuuucagcugguggagacauuugggugacaagagaaccuuaugugucaugcgauccuggcaaguguuaucaauuugcacuuggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcucauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccggaauccuaacaaugagaaagggagucauggagugaaaggcugggccuuugacgauggaaaugacguguggaugggaagaacgaucggcgaggaguuacgcucagguuaugaaaccuucagagucauuggaggcugguccacaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52564 - RNA, 1410 nt, Artificial Sequence; identical to SEQ ID NO: 52435
  neuraminidase__InfluenzaA__AFG99902

SEQ ID NO: 52565 - RNA, 1410 nt, Artificial Sequence
  neuraminidase__InfluenzaA__AFG99913
augaauccaaaucaaaagauaauaacaauuggcucuguuucucucaccauugccacaauaugcuuccuuaugcaaauugccauccugguaacuacuguaacauugcauuucaagcaauaugagugcaacucccccccaaacaaccaaguaaugccgugugagccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuaggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggagacuuguagauaguauuguuucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggggucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggaggcugguccacaccuaacuccaaauugcagacaaauaggcaagucauaguugacagagguaauagguccgguuauucugguauuuucucuguugaaggcaaaagcugcaucaaucggugcuuuuauguagaauugauaaggggaaggaaacaggaaacuaaagucugguggaccucaaacaguauuguuguguuuuguggcaccucagguacauauggaacaggcucauggccugauggggcggacaucaaucucaugccuauauaa

SEQ ID NO: 52566 - RNA, 1410 nt, Artificial Sequence; identical to SEQ ID NO: 52435
  neuraminidase__InfluenzaA__AFG99924

SEQ ID NO: 52567 - RNA, 1410 nt, Artificial Sequence
  neuraminidase__InfluenzaA__AFG99935
augaauccaaaucaaaagauaauaacaauuggcucuguuucucucacuauugccacaauaugcuuccuuaugcaaauugccauccugguaacuacuguaacauugcauuucaagcaauacgagugcaacucccccccaaacaaccaaguaaugcugugugaaccaacaauaguagaaagaaacauaacagagauaguguauuugacuaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuagcaaguguuaucaauuugcacuuggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaauaugaaagauuauagcauuguuuccaguuaugugugcucagggcuuguuggagacacacccagaaacaacgacagcuccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggaggcugguccacaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52568 - RNA, 1410 nt, Artificial Sequence
  neuraminidase__InfluenzaA__AFG99946
augaauccaaaucaaaagauaauaacaauuggcucuguuucucucaccauugccacaauaugcuuccuuaugcaaauugccauccugguaacuacuguaacauugcauuucaagcaauaugagugcaacucccccccaaacaaccaaguaaugccgugugaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuaggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggaggcuuguagauaguauuguuucaugguccaaaaauauccucaggacccaggagucggaaugcguuuguaucaauggaaccuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggaggcugguccacaccuaacuccaaauugcagacaaauaggcaagucauaguugacagagguaauagguccgguuauucugguauuuucucuguugaaggcaaaagcugcaucaaucggugcuuuuauguagaauugauaaggggaaggaaacaggaaacuaaagucugguggaccucaaacaguauuguuguguuuuguggcacaucagguacauauggaacaggcucauggccugauggggcggacaucaaucucaugccuauauaa

SEQ ID NO: 52569 - RNA, 1410 nt, Artificial Sequence
  neuraminidase__InfluenzaA__AFG99957
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaagcaaugcugugugaaccaacaauaauagaaagaaacauaacagagauaguguauuugacuaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggcuuuugacgauggaaaugacguguggaugggaagaacgaucggcgaggaguuacgcucagguuaugaaaccuucaaagucauuggaggcugguccacaccuaacuccaaauugcagauaaauaggcaagucauaguugacagagguaauagguccgguuauucugguauuuucucuguugaaggcaaaagcugcaccaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52570 - RNA, 1410 nt, Artificial Sequence
  neuraminidase__InfluenzaA__AFG99968
augaauccaaaucaaaagauaauaacaauuggcucuguuucucucaccauugccacaauaugcuuccuuaugcaaauugccauccugguaacuacuguaacauugcauuucaagcaauaugagugcaacucccccccaaacaaccaaguaaugccgugugaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuaggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggaggcuuguagauaguauuguuucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggaggcugguccacaccuaacuccaaauugcagacaaauaggcaagucauaguugacagagguaauagguccgguuauucugguauuuucucuguugaaggcaaaagcugcaucaaucggugcuuuuauguagaauugauaaggggaaggaaacaggaaacuaaagucugguggaccucaaacaguauuguuguguuuuguggcaccucagguacauauggaacaggcucauggccugauggggcggacaucaaucucaugccuauauaa

SEQ ID NO: 52571 - RNA, 1410 nt, Artificial Sequence
  neuraminidase__InfluenzaA__AFG99979
augaauccaaaucaaaagauaauaacaauuggcucuguuucucucaccauugccacaauaugcuuccuuaugcaaauugccauccugguaacuacuguaacauugcauuucaagcaauaugagugcaacucccccccaaacaaccaaguaaugccgugugaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuaggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggaggcuuguagauaguauuguuucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccugaauccuaacaaugagaaagggagucauggagugaaaggcugggccuuugacgauggaaaugacguguggaugggaagaacgaucggcgaggaguuacgcucagguuaugaaaccuucaaagucauuggaggcugguccacaccuaacuccaaauugcagacaaauaggcaagucauaguugacagagguaauagguccgguuauucugguauuuucucuguugaaagcaaaagcugcaucaaucggugcuuuuauguagaauugauaaggggaaggaaacaggaaacuaaagucugguggaccucaaacaguauuguuguguuuuguggcacaucagguacauauggaacaggcucauggccugauggggcggacaucaaucucaugccuauauaa

SEQ ID NO: 52572 - RNA, 1410 nt, Artificial Sequence
  neuraminidase__InfluenzaA__AFG99990
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaagcaaugcugugugaaccaaaaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucagaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52573 - RNA, 1410 nt, Artificial Sequence
  neuraminidase__InfluenzaA__AFH00002
augaauccaaaucaaaagauaauaacaauuggcucuguuucucucacuauugccacaauaugcuuccuuaugcaaauugccauucugguaacuacuguaacauugcauuucaagcaauaugagugcagcucccccccaaacaaccaaguaauuccaugucaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaauguuaucaauuugcacuuggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggaggcuuguagauaguauugguucaugguccaaaaauauccucaggacccaggagucggaaugcguuuguaucaaugggacuugugcaguaguaaugacugauggaagugcuucagaaagagcugauacuaaaauacuauucauugaagaggggaaagucguucauauuagcccauugucaggaagugcucagcauguagaggagugcuccuguuauccucgauauccuggugucagaugugucugcagagacaacuggaaaggcuccaauaggcccaucguagacauaaaugugaaaaauuauagcauuguuuccaguuaugugugcucagggcuuguuggagacacacccagaaaaaacgacagcuccagcaguagcuauugccggaauccuaacaaugagaaagggagucauggggugaaaggcugggccuuugacgauggaaaugacguguggaugggaagaacgaucagcgaggaguuacgcucagguuaugaaaccuucaaagucauuggagguugguccacaccuaauuccaaauugcagauaaauaggcaagucauaguugacagcgguaauagguccgguuauucugguauuuucucuguugaaggcaaaagcugcaucaaucggugcuuuuauguggaguugauaaggggaaggaaacaggaaacuaaagucugguggaccucaaacaguauuguuguguuuuguggcaccucagguacauauggaacaggcucauggccugauggggcggacaucaaucucaugccuauauaa

SEQ ID NO: 52574 - RNA, 1410 nt, Artificial Sequence
  neuraminidase__InfluenzaA__AFH00013
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguauuugacuaacaccaccauagagaaagaaauaugccccaaacuagcagaauacagaaauuggucaaagccccaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccguuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucagaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuacccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaaucccaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52575 - RNA, 1410 nt, Artificial Sequence
  neuraminidase__InfluenzaA__AFH00024
augaauccaaaucaaaagauaauaacaauuggcucuguuucucucacuauugccacaauaugcuuccuuaugcaaauuaccauccugguaacuacuguaacauugcauuucaagcaauaugagugcaacucccccccaaacaaccaaguaaugcugugugaaccaacaauaauagaaagaaacauaacagagauaguguauuugacuaacaccaccauagagaaagagauaugccccaaacuaguagaauacagaaauuggucaaagccgcaauguaaaaucacaggauuugcaccuuuuucuaaggacaauucaauucggcuuuccgcugguggagacauuugggugacaagagaaccuuaugugucaugcgauccuggcaaguguuaucaauuugcacuuggacagggaaccacacuaaacaacaggcauucaaaugacacaguacaugauaggaccccuuaucgaacccucuugaugaaugaguuggguguuccauuucauuugggaaccaagcaagugugcauagcaugguccaguucaaguugucacgauggaaaagcauggcugcauguuugugucacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggagaaucguucauauuagcccauugucaggaagugcucagcauguagaggagugcuccuguuauccucgauacccuggugucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccggaauccuaacaaugagaaaggaagucauggagugaaaggcugggccuuugacgauggaaaugacguguggaugggaagaacgaucagcgaggaguuacgcucagguuaugaaaccuucaaagucauuggaggcugguccacaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaaauaaagucugguggaccucaaacaguauuguuguguuuuguggcaccucagguacauauggaacaggcucauggccugauggggcggacaucaaucucaugccuauauaa

SEQ ID NO: 52576 - RNA, 1410 nt, Artificial Sequence
  neuraminidase__InfluenzaA__AFH00035
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguauuugacuaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccguuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucagaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52577 - RNA, 1410 nt, Artificial Sequence; identical to SEQ ID NO: 52576
  neuraminidase__InfluenzaA__AFH00046

SEQ ID NO: 52578 - RNA, 1410 nt, Artificial Sequence
  neuraminidase__InfluenzaA__AFH00057
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauguccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaacccuaacuccaaauugcagauaaauaggcaagucauaguugacagagguaauagauccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52579 - RNA, 1410 nt, Artificial Sequence
  neuraminidase__InfluenzaA__AFH00068
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaaaccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcacucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagagggaaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52580 - RNA, 1410 nt, Artificial Sequence
  neuraminidase__InfluenzaA__AFH00079
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguauuugacuaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccguuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52581 - RNA, 1410 nt, Artificial Sequence
  neuraminidase__InfluenzaA__AFH00090
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugcuggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauaggucugguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52582 - RNA, 1410 nt, Artificial Sequence
  neuraminidase__InfluenzaA__AFH00101
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaaaccgcaauguaaaauuacaggauuugcaccuuuuucuaaggacaauucaauuaggcuuuccgcugguggagacauuugggugacaagagaaccuuaugugucaugcgauccuggcaaguguuaucaauuugcccuuggacagggaacaacacuaaacaacaggcacucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugauggaagugcuucagaaagagcugauacuaaaauacuauucauugaagagggaaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52583 - RNA, 1410 nt, Artificial Sequence; identical to SEQ ID NO: 45776
  neuraminidase__InfluenzaA__AFH00112

SEQ ID NO: 52584 - RNA, 1410 nt, Artificial Sequence
  neuraminidase__InfluenzaA__AFH00123
augaauccaaaucaaaagauaauaacaauuggcucuguuucucucacuauugccacaauaugcuuucuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaauaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52585 - RNA, 1410 nt, Artificial Sequence
  neuraminidase__InfluenzaA__AFH00156
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaaacaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucauagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52586 - RNA, 1410 nt, Artificial Sequence
  neuraminidase__InfluenzaA__AFH00167
augaauccaaaucaaaagauaauaacaauuggcucuguuucucucacuauugccacaaugugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguauaaauggaacuuguacaguaguaaugacugauggaagugcuucagaaagagcugauacuaaaauacuauucauugaagaagggaaaaucguucauauuagcccauugucaggaagugcucagcaugucgaggagugcuccuguuauccucgauauccuggugucagaugugucugcagagacaacuggaaaggcuccaauaggccaaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguugcgcucagguuaugaaaccuucaaagucauuggaggcugguccaaaccuaacuccaaauugcagauaaauaggcaagucauaguugacagagguaauagauccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52587 - RNA, 1410 nt, Artificial Sequence; identical to SEQ ID NO: 52585
  neuraminidase__InfluenzaA__AFH00178

SEQ ID NO: 52588 - RNA, 1410 nt, Artificial Sequence
  neuraminidase__InfluenzaA__AFH00189
augaauccaaaucaaaagauaauaacaauuggcucuguuucucucacuauugccacaauaugcuuccuuaugcaaauugccauccugguaacuacuguaacauugcauuucaagcaauaugaguacaacucccccccaaacaaccaaguaaugcugugugaaccaaaaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcacucaaaugacacaguacaugauaggaccccuuaucgaacccuauugaugaaugaauuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52589 - RNA, 1410 nt, Artificial Sequence
  neuraminidase__InfluenzaA__AFH00200
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcacucaaaugacacaguacaugauaggaccccuuaucgaacccuacugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52590 - RNA, 1410 nt, Artificial Sequence
  neuraminidase__InfluenzaA__AFH00211
augaauccaaaucaaaagauaauaacaauuggcucuguuucucucacuauugccacaaugugcuuccuuaugcaaauugccauccugguaacuacuguaacauugcauuucaagcaauaugagugcaacucccccccaaacaaccaaguaaugcuaugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagggcugauacuaaaauacuauucauugaagaggggaaaaucguucauauuagcccauugucaggaagugcucagcaugucgaggagugcucauguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagauccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52591 - RNA, 1410 nt, Artificial Sequence
  neuraminidase__InfluenzaA__AFH00222
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuauguaucaugcgauccuggcaaguguuaucaauuugcacuuggacagggaacaacacuaaacaacaggcauucaaauaacacaguacaugauaggaccccuuaucgaacccuauugaugaaugaguuggguguuccauuucauuuggggaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52592 - RNA, 1410 nt, Artificial Sequence; identical to SEQ ID NO: 45626
  neuraminidase__InfluenzaA__AFH00233

SEQ ID NO: 52593 - RNA, 1410 nt, Artificial Sequence
  neuraminidase__InfluenzaA__AFH00244
augaauccaaaucaaaagauaauaacaauuggcucuguuucucucacuauugccacaauaugcuuccuuaugcaaauugccauccugguaacuacuguaacauuguauuucaagcaauaugagugcaacucccccccaagcaaccaaguaaugcugugugaaccaacaauaguagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugaugggagugcuucagaaagagcugauacuaaaauacuauucauugaagaggggaaaaucguucauauuagcccauugucaggaagugcuaagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52594 - RNA, 1410 nt, Artificial Sequence
  neuraminidase__InfluenzaA__AFH00255
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguauuugacuaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucaggugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52595 - RNA, 1410 nt, Artificial Sequence
  neuraminidase__InfluenzaA__AFH00266
augaauccaaaucaaaagauaauaacaauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucacauuagcccauugucaggaagugcucagcaugucgaggagugcucauguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52596 - RNA, 1410 nt, Artificial Sequence
  neuraminidase__InfluenzaA__AFH00277
augaauccaaaucaaaagauaauaacaauuggcucuguuucucucacuauugccacaauaugcuuucuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaaaccuaacaaugagaaagggagucauggauugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52597 - RNA, 1410 nt, Artificial Sequence; identical to SEQ ID NO: 47096
  neuraminidase__InfluenzaA__AFH00288

SEQ ID NO: 52598 - RNA, 1410 nt, Artificial Sequence
  neuraminidase__InfluenzaA__AFH00299
augaauccaaaucaaaagauaauaacaauuggcucuguuucucucaccauugccacaauaugcuuccuuaugcaaauugccauccugguaacuacuguaacauugcauuucaagcaauaugagugcagcucccccccaaacaaccaaguaaugccgugugaaccaacaauaauagaaagaaacauaacagagauaguguauuugacuaacacuaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggaggcuuguagauaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggagguugguccacaccuaacuccaaauugcagauaaauaggcaagucauaguugacagcgguaauagguccgguuauucugguauuuucucuguugagggcaaaagcugcaucaaucggugcuuuuauguggaguugauaaggggaaggaaacaggaaacuaaagucugguggaccucaaacaguauuguuguguuuuguggcaccucagguacauauggaacaggcucauggccugauggggcggacaucaaucucaugccuauauaa

SEQ ID NO: 52599 - RNA, 1410 nt, Artificial Sequence
  neuraminidase__InfluenzaA__AFH00310
augaauccaaaucaaaagauaauaacaauuggcucuguuucucucacuauugccacaauaugcuuccuuaugcaaauugccauucugguaacuacuguaacauugcauuucaagcaauaugagugcagcuccuccccaaacaaccaaguaauuccaugucaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaauguuaucaauuugcacuuggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggaggcuuguagauaguauugguucaugguccaaaaauauccucaggacccaggagucggaaugcguuuguaucaaugggacuuguacagugguaaugacugauggaagugcuucagaaaaagcugauacuaaaauacuauucauugaagaggggaaagucguucauauuagcccauugucaggaagugcucagcauguagaggagugcuccuguuauccucgauauccuggugucagaugugucugcagagacaacuggaaaggcuccaauaggcccaucguagacauaaaugugaaaaauuauagcauuguuuccaguuaugugugcucagggcuuguuggagacacacccagaaaaaacgacagcuccagcaguagcuauugccggaauccuaacaacgagaaagggagucauggggugaaaggcugggccuuugacgauggaaaugacguguggaugggaagaacgaucagcgaggaguuacgcucagguuaugaaaccuucaaagucauuggagguugguccacaccuaauuccaaauugcagauaaauaggcaagucauaguugacagcgguaauagguccgguuauucugguauuuucucuguugaaggcaaaagcugcaucaaucggugcuuuuauguggaguugauaaggggaaggaaacaggaaacuaaagucugguggaccucaaacagucuuguuguguuuuguggcaccucagguacauauggaacaggcucauggccugauggggcggacaucaaucucaugccuauauaa

SEQ ID NO: 52600 - RNA, 1410 nt, Artificial Sequence; identical to SEQ ID NO: 52599
  neuraminidase__InfluenzaA__AFH00321

SEQ ID NO: 52601 - RNA, 1410 nt, Artificial Sequence
  neuraminidase__InfluenzaA__AFH00332
augaauccaaaucaaaagauaauaacaauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcagcagccauugccugaauccuaacaaugaggaagggggucauggagugaaaggcugggccuuugaugauggaaaugacguguggaugggaagaacgaucagcgagaaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaggcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52602 - RNA, 1410 nt, Artificial Sequence
  neuraminidase__InfluenzaA__AFH00343
augaauccaaaucaaaagauaauaacaauuggcucuguuucucucacuauugccacaauaugcuuccuuaugcaaauugccauccugguaacuacuguaacauugcauuucaagcaauaugagugcaacucccccccaagcaaccaagcaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52603 - RNA, 1410 nt, Artificial Sequence
  neuraminidase__InfluenzaA__AFH00354
augaauccaaaucaaaagauaauaacaauuggcucuguuucucucacuauugccacaauaugcuuccuuaugcagauugccauccugguaacuacuguaacauugcauuucaagcaauaugaaugcaacucccccccaaacaaccaaguaaugcugugugaaccaacaauaauagaaagaaacauaacaaagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccugaauccuaacaaugaggaagggggucauggagugaaaggcugggccuuugaugauggaaaugacguguggaugggaagaacgaucagcgagaaguuacgcucagguuaugaaaccuucaaggucauuggaggcugguccaaaccuaacuccaaauugcagauaaauaggcaagucauaguugacagagguaauagguccgguuauucugguauuuucucuguugaaggaaaaagcugcgucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52604 - RNA, 1410 nt, Artificial Sequence
  neuraminidase__InfluenzaA__AFH00365
augaauccaaaucaaaagauaauaacaauuggcucuguuucucucacuauugccacaauaugcuuccuuaugcaaauugccauccugguaacuacuguaacauuacauuucaagcaauaugaaugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcccauugucaggaagugcucagcacgucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccugaauccuaacaaugaggaagggggucauggagugaaaggcugggccuuugaugauggaaaugauguguggaugggaagaacgaucagcgagaaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52605 - RNA, 1410 nt, Artificial Sequence
  neuraminidase__InfluenzaA__AFH00376
augaauccaaaucaaaagauaauaacaauuggcucuguuucucucacuauugccacaauaugcuuccuuaugcaaauugccauccugguaacuacuguaacauuacauuucaagcaaugugaaugcaacucccccccaaacaaccaaguaaugcugugugaaccaacaauaauagagagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauauuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccugaauccuaacaaugaggaaggaggucauggagugaaaggcugggccuuugaugauggaaaugauguguggaugggaagaacgaucagcgagaaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52606 - RNA, 1410 nt, Artificial Sequence
  neuraminidase__InfluenzaA__AFH00387
augaauccaaaucaaaagauaauaacaauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauuaguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccugaauccuaacaaugaggaagggggucauggagugaaaggcugggccuuugaugauggaaaugacguguggaugggaagaacgaucagcgaaaaguuacgcucagguuaugaaaccuucaaggucauuggaggcugguccaaaccuaacuccaaauugcagauaaauaggcaagucauaguugacagagguaauagguccgguuauucugguauuuucucuguugaaggcaaaagcugcgucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52607 - RNA, 1410 nt, Artificial Sequence
  neuraminidase__InfluenzaA__AFH00398
augaauccaaaucaaaagauaauaacaauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgauagcuccagcaguagcuauugccugaauccuaacaaugaggaagggggucauggagugaaaggcugggccuuugaugauggaaaugacguguggaugggaagaacgaucagcgagaaguuacgcucagguuaugaaaccuucaaggucauuggaggcugguccaaaccuaacuccaaauugcagauaaauaggcaagucauaguugacagagguaauagguccgguuauucugguauuuucucaguugaaggcaaaagcugcgucaaucggugcuuuuauguggaguugauaaggggaagaaaacaggaaacugaagucugguggaccucaaacaguauuguuguguuuuguggcaccucagguacauauggagcaggcucauggccugauggggcggacaucaaucucaugccuauauaa

SEQ ID NO: 52608 - RNA, 1410 nt, Artificial Sequence
  neuraminidase__InfluenzaA__AFH00409
augaauccaaaucaaaagauaauaacaauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaauuggguguuccauuucauuugggaaccaagcaagugugcauagcaugguccagcucaaguugucacgauggaaaagcauggcugcauguuuguguaacugggcauaaugaaaaugcaacugcuagcuucauuuacgaugggaggcuuguggauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaagaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacucguuggagacacacccagaaaaaacgacagcuccagcaguagcuauugccugaauccuaacaaugaggaagggggucauggagugaaaggcugggccuuugaugauggaaaugauguguggaugggaagaacgaucagcgagaaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52609 - RNA, 1410 nt, Artificial Sequence
  neuraminidase__InfluenzaA__AFH00420
augaauccaaaucaaaagauaauaacaauuggcucuguuucucucacuauugccacaauaugcuuccuuaugcaaauugccauccugguaacuacuguaacauuacauuucaagcaauaugaaugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcacccuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccugaauccuaauaaugaggaagggggucauggagugaaaggcugggccuuugaugauggaaaugauguguggaugggaagaacgaucagcgagaaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugacggggcggacaucaaucucaugccuauauaa

SEQ ID NO: 52610 - RNA, 1410 nt, Artificial Sequence; identical to SEQ ID NO: 45617
  neuraminidase__InfluenzaA__AFH00431

SEQ ID NO: 52611 - RNA, 1410 nt, Artificial Sequence
  neuraminidase__InfluenzaA__AFH00442
augaauccaaaucaaaagauaauaacaauuggcucuguuucucucacuauugccacaauaugcuuccuuaugcaaauugccauccugguaauuacuguaacauugcauuucaagcaauaugaaugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcauaaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugauguguggaugggaagaacgaucagcgagaaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggagcggacaucaaucucaugccuauauaa

SEQ ID NO: 52612 - RNA, 1410 nt, Artificial Sequence
  neuraminidase__InfluenzaA__AFH00453
augaauccaaaucaaaagauaauaacgauuggcucuguuucucucacuauugccacaauaugcuuccuuaugcaaauugccauccugguaacuacuguaacauuacauuucaagcaauaugaaugcaacucccccccaaacaaccaaguaaugcugugugaaccaacaauaauagaaagaaacauaacagagguaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacauaguacaugauaggaccccuuaucgaacccuauugaugaaugaguuggguguuccauuucauuugggaaccaagcaaguaugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugauggaagugcuucaggaagagcugauacuaaaauacuauucauugaggaggggaaaaucguucauauuagcccauugucaggaagugcucagcaugucgaggagugcuccuguuauccucgauauccuggugucagaugugucugcagagacaacuggaaaggcuccaauaggcccaucguagauauaaauguaaaagauuauagcauuguuuccaguuaugugugcucaggacuuguuggagacacacccagaaaaaacgacagcuccagcagcagccauugccugaauccuaacaaugaggaagggggucauggagugaaaggcugggccuuugaugauggaaaugacguguggaugggaagaacgaucagcgagaaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52613 - RNA, 1410 nt, Artificial Sequence
  neuraminidase__InfluenzaA__AFH00464
augaauccaaaucaaaagauaauaacaauuggcucuguuucucucacuauugccacaauaugcuuccuuaugcaaauugccauccugguaacuacuguaacauuacauuucaagcaauaugaaugcaacucccccccaaacaaccaaguaaugcugugugaaccaacaauaauagaaagaaacauaacagagauaguguaucugaccaacaccaccauagagaaagaaauaugccccaagcuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaaaaacaggcauucaaaugacacaguacaugauaggaccccuuaucgaacccuauugaugaaugagcuggguguuccauuucauuugggaaccaagcaagugugcauagcaugguccagcucaaguugucacgauggaaaagcauggcugcauguuuguguaacugggcaugaugaaaaugcaacugcuagcuucauuuacggugggaggcuuguagauaguauugguucaugguccaaaaaaauccucaggacccaggagucggaaugcguuuguaucaauggaacuuguacaguaguaaugacugauggaagugcuucaggaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaagaacgacagcuccagcaguagcuauugccugaauccuaacaaugaggaagggggucauggagugaaaggcugggccuuugaugauggaaaugauguguggaugggaagaacgaucagcgagaaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52614 - RNA, 1410 nt, Artificial Sequence
  neuraminidase__InfluenzaA__AFH00475
augaauccaaaucaaaagauaauaacgauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcaauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauauuagcccauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaguuacgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52615 - RNA, 1410 nt, Artificial Sequence
  neuraminidase__InfluenzaA__AFH00486
augaauccaaaucaaaagauaauaacgauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauauuagcccauuguuaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaguuacgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52616 - RNA, 1410 nt, Artificial Sequence
  neuraminidase__InfluenzaA__AFH00497
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauaaagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugcuggaauccuaacaaugagaaagggggucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52617 - RNA, 1410 nt, Artificial Sequence
  neuraminidase__InfluenzaA__AFH00508
augaauccaaaucaaaagauaauaacaauuggcucuguuucucucacuauugccacaauaugcuuccuuaugcaaauugccauccugguaauuacuguaacauugcauuucaagcaauaugaaugcaacucccccccaaacaaccaaguaaugcugugugaaccaacaauaauagaaagaaacauaacagagauaguguaucugaccaacaccaccauagagaaagaaauaugccccaaacuagcagaauacagaaacuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcauaaugaaaaugcaacugcuagcuucauuuacgaugggaggcucguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugauguguggaugggaagaacgaucagcgagaaauuacgcucagguuaugaaaccuucagagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52618 - RNA, 1410 nt, Artificial Sequence
  neuraminidase__InfluenzaA__AFH00519
augaauccaaaucaaaagauaauaacaauuggcucuguuucucucacuauugccacaaugugcuuccuuaugcaaauugccauccugguaacuacuguaacauugcauuucaagcaauaugaaugcaacucccccccaaacaaccaaguaaugcugugugaaccaacaauaauagagagaaacauaacagagauaguguaucugaccaacaccaccauagaaaaagaaauaugccccaaacuagcagaauacagaaauuggucaaagccgcaauguaaaauuacaggauuugcaccuuuuucuaaggacaauucaauucggcuuuccgccgguggagacauuugggugacaagagaaccuuaugugucaugcgauccuggcaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacuggacaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcccacugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugauguguggaugggaagaacgaucagcgagaaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguagaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52619 - RNA, 1410 nt, Artificial Sequence
  neuraminidase__InfluenzaA__AFH00530
augaauccaaaucaaaagauaauaacgauuggcucuguuucucucacuauugccacaauaugcuuccuuaugcaaauugccauccugguaacuacuguaacauugcauuucaagcaauaugaaugcagcucucccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagggaaccuuaugugucgugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauaucagcccacugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagucauugccugaauccuaacaaugaggaagggggucauggagugaaaggcugggccuuugaugauggaaaugacguguggaugggaagaacgaucagcgagaaguuccgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52620 - RNA, 1410 nt, Artificial Sequence
  neuraminidase__InfluenzaA__AFH00541
augaauccaaaucaaaagauaauaacgauuggcucuguuucucucacuauugccacaauaugcuuccuuaugcaaauugccauccugguaacuacuguaacacugcauuucaagcaauaugaaugcagcucucccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagggaaccuuaugugucgugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauaucagcccacugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagucauugccugaauccuaacaaugaggaagggggucauggagugaaaggcugggccuuugaugauggaaaugacguguggaugggaagaacgaucagcgagaaguuccgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52621 - RNA, 1410 nt, Artificial Sequence
  neuraminidase__InfluenzaA__AFH00552
augaauccaaaucaaaagauaauaacgauuggcucuguuucucucacuauugccacaauaugcuuccuuaugcaaauugccauccugguaacuacuguaacauugcauuucaagcaauaugaaugcaacucucucccaaacaaccaaguaaugcugugugaaccaacaauaauagaaagaaacauaacagagauaguguaucugaccaacaccaccauagagaaggagauaugccccaaacuagcagaauacagaaauuggucaaagccgcaauguaaaauuacaggauuugcaccuuucucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccuuuucauuugggaaccaagcaagugugcauagcaugguccagcucaaguugucacgauggaaaagcauggcugcauguuuguguaacugggcacgaugaaaaugcaacugcuagcuucauuuacgaugggaggcuuguagauaguauuggcucaugguccaaaaaaauccucaggacccaggagucggaaugcguuuguaucaauggaacuuguacaguaguaaugacugaugggagugcuucaggaagagcugauacuaaaauacuauucauugaggaggggaaaaucauucauauuagccaauugucaggaaguacucagcaugucgaggagugcucauguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaauuccgcucagguuaugaaaccuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucguggccugauggggcggauaucaaucucaugccuauauaa

SEQ ID NO: 52622 - RNA, 1410 nt, Artificial Sequence
  neuraminidase__InfluenzaA__AFH00563
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaauguuaucaauuugcccuuggacagggaacaacacuaaacaacgggcauucaaaugacacaguacaugagaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcccauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaauuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 52623 - RNA, 1410 nt, Artificial Sequence
  neuraminidase__InfluenzaA__AFH00574
augaauccaaaucaaaagauaauaacgauuggcucuguuucucucaccauugcaacaauaugcuuccuuaugcaaauugccauccugguaacuacuguaacauugcauuucaagcaauaugaaugcaacucccccccaaacaaccaagugaugcugugugaaccaaaaauaauagaaagaaacauaacagagauaguguaucugaacaacaccaccauagagaaggaaauaugccccaaacuagcagaauacagaaauuggucaaagccgcaauguaacauuacuggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggugaugaugaaaaugcaacugcuagcuucauuuacaaugggaggcuuguagauaguauagguucaugguccaaaaaaauccucaggacccaggaaucggaaugcguuuguaucaauggaacuuguacaguaguaaugacugauggaagugcuucaggaaaagcugauacuaaaauacuauucauugaggaggggaaaaucguucauacuagccuauugucagggagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 52624 - RNA, 1410 nt, Artificial Sequence
  neuraminidase__InfluenzaA__AFH00585
augaauccaaaucaaaagauaauaacgauuggcucuguuucucucaccauugccacaauaugcuuccuuaugcaaauugccauccugguaacuacuguaacguugcauuucaagcaauaugaaugcaacucccccccaaacaaccaagugaugcugugugaaccaacaauaauagaaagaaacauaacagagauaguguaucugaccaacaccaccauaaagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacaggcauucaaaugacaaaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguaucgguucaugguccaaaaaaauccucaggacccaggagucggaaugcguuuguaucaauggaacuuguacaguaguaaugacugaugggagugcuucaggaaaagcugauacuaaaauacuauucauuaaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaagcuaacuccaaauugcagauaaauaggcaagucauaguugacagagguaauagguccgguuauucugguauuuucucuguugaaagcaaaagcugcaucaauaggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 52625 - RNA, 1410 nt, Artificial Sequence
  neuraminidase__InfluenzaA__AFH00596
augaauccaaaucaaaagauaauaacaauuggcucuguuucucucaccauugccacaauaugcuuccuuaugcaaauugccauccugguaacuacuguaacauugcauuucaagcaguaugaaugcaacccccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacaucacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52626 - RNA, 1410 nt, Artificial Sequence
  neuraminidase__InfluenzaA__AFH00607
augaauccaaaucaaaagauaauaacaauuggcuuuguuuuuuucaccauugccacaauaugcuuccuuaugcaaauugccauccugguaacuacuguaacauugcauuucaagcaguaugaaugcaacccccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacaucacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52627 - RNA, 1410 nt, Artificial Sequence
  neuraminidase__InfluenzaA__AFH00618
augaauccaaaucaaaagauaauaacgauuggcucuguuucccucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaauuguucauacuagcacauuaucaggaagugcucagcaugucgaggagugcuccuguuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccaaacaaugaggaagguggucauggagugaaaggcugggccuuugaugauggaaaugacguguggaugggaagaacgaucagcgagaaguuacgcucaggauaugaaaccuucaaaguaauugaaggcugguccaacccuaacuccaaauugcagauaaauaggcaagucauaguugacagagguaacagguccgguuauucugguauuuucucuguugaaggcaaaagcugcaucaaucggugcuuuuauguggaguugauaaggggaagaaaacaggaaacugaagucuuguggaccucaaacaguauuguuguguuuuguggcaccucagguacauauggaacaggcucauggccugauggggcggacaucaaucucaugccuauauaa

SEQ ID NO: 52628 - RNA, 1410 nt, Artificial Sequence
  neuraminidase__InfluenzaA__AFH00629
augaauccaaaucaaaagauaauaacaauuggcucuguuucucucaccauugccacaauaugcuuccuuaugcaaauuaccauccugguaacuacuguaacauugcauuucaagcaguaugaaugcaacucccccccaaacaaccaaguaaugcugugugaaccaacaauaauagaaagaaacauaacagagauaguguaucugaccaauaccacuauagagaagggaauaugccccaaauuagcagaauacagaaauuggucaaagccgcaauguaacauuacaggauuugcaccuuuuucuaaggacaauucgauucggcuuuccgcugguggggacaucugggugacaagagagccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuaguuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucauucacauuagcacauuguuaggaagugcucagcaugucgaggagugcuccuguuauccucgauauccuggugucagauguguaugccgagacaacuggaaaggcuccaauaggcccaucguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 52629 - RNA, 1410 nt, Artificial Sequence; identical to SEQ ID NO: 44870
  neuraminidase__InfluenzaA__AFH00640

SEQ ID NO: 52630 - RNA, 1410 nt, Artificial Sequence; identical to SEQ ID NO: 46960
  neuraminidase__InfluenzaA__AFH00651

SEQ ID NO: 52631 - RNA, 1410 nt, Artificial Sequence
  neuraminidase__InfluenzaA__AFH00662
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaagcuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcucuagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggagcugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52632 - RNA, 1410 nt, Artificial Sequence
  neuraminidase__InfluenzaA__AFH00673
augaauccaaaucaaaagauaauaacgauuggcucuguuucucucaccauuuccacaauaugcuucuucaugcaaauugccaucuugauaacuacuguaacauugcauuucaagcaauaugaauucagcucccccccaaacaaccaagugaugcugugugaaccaacaauaauagaaagaaacauaacagagauaguguaucugaccaacaccaccauagagaaggaaacaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacacugucaggaagugcucagcaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgugaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaccgaaguuuuguggaccucaaacaguauuguuguguuuuguggcaccucagguacauauggaacaggcucauggccugauggggcggacaucaaucucaugccuauauaa

SEQ ID NO: 52633 - RNA, 1410 nt, Artificial Sequence
  neuraminidase__InfluenzaA__AFH00684
augaauccaaaucaaaagauaauaacgauugggucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaacucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugagaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcauguugaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucaggcacauauggaacaggcucauggccugauggggcggacaucaaucucaugccuauauaa

SEQ ID NO: 52634 - RNA, 1410 nt, Artificial Sequence
  neuraminidase__InfluenzaA__AFH00695
augaauccaaaucaaaagauaauaacgauuggcucuguuucucucaccauuuccacaauauguuucuucaugcaaauugccaucuugauaacuacuguaacauugcauuucaagcaauaugaauucaacucccccccaaacaaccaagugaugcugugugaaccaacaauaauagaaagaaacauaacagaaauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugaaaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaacgggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 52635 - RNA, 1410 nt, Artificial Sequence
  neuraminidase__InfluenzaA__AFH00706
augaauccaaaccaaaagauaauaacgauuggcucuguuucccucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacaaggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgaugggaaagcauggcugcauguuuguauaacgggggacgauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucaucgaggaggggaaaaucguucauacuagcacauugucaggaagugcucaacaugucgaggagugcuccugcuauccucgauauccuggugucagaugugucugcagagacaacuggaaaggcuccaauaggcccaucguagauauaaacaugaaggaucauagcauuguuuccaguuauguguguucaggacuuguuggagacacacccagaaaaaacgacagcuccagcaguagccauuguuuugauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauaaggggaaguaaagaggaaacugaaguauuguggaccucaaacaguauuguuguguuuuguggcaccucagggacauauggaacaggcucauggccugauggggcggacaucaaucucaugccuauauaa

SEQ ID NO: 52636 - RNA, 1410 nt, Artificial Sequence
  neuraminidase__InfluenzaA__AFH00728
augaauccaaaucaaaagauaauaacaauuggcucuguuucucucaccauugcaacaauaugcuuccuuaugcaaauugccauccugguaacuacuguaacauugcauuucaagcaauaugagugcagcucccccccaaacaaccaaguaaugccgugugaaccaauaauaauagaaagaaacauaacagagauaguguauuugacuaacaccaccauagagaaagagauaugccccaaacuaguggaauacagaaauuggucaaagccgcaauguaaaauuacaggauuugcaccuuuuucuaaggacaauucaauucggcuuuccgcugguggggacauuugggugacgagagaaccuuaugugucaugcgauccuggcaaguguuaucaauuugcacucgggcagggaaccacacuaaacaacaagcauucaaaugacacaauacaugauaggaccccuuaucgaacccuauugaugaaugaguuggguguuccauuucauuugggaaccaggcaagugugcauagcaugguccagcucaaguugucacgauggaaaagcauggcugcauguuugugucacugggcaugauaaaaaugcaacugcuagcuucauuuacaaugggaggcuuguagacaguauugguucaugguccaaaaauauccucaggacccaggagucggaaugcguuuguaucaaugggacuuguacaguaguaaugacugauggaagugcuucagaaagagcugacacuaaaauacuauucauugaagaggggaaaaucguucauauuagcccauugucaggaagugcucagcauguagaggaguguuccuguuauccucgauauccuggugucagaugugucugcagagacaacuggaaaggcuccaauaggcccaucguagauauaaaugugaaagauuauagcauuguuuccaguuaugugugcucagggcuuguuggcgacacacccagaaaaaacgacagaucuagcaguagcuauugccggaauccuaacaaugagaaagggaaucauggagugaaaggcugggccuuugacgauggaaaugacguguggaugggaagaacgauuggcgaggaguuacgcucagguuaugaaaccuucaaagucauuggugguugguccacaccuaauuccaaauugcagauaaauaggcaagucauaguugacagcgauaauagguccgguuauucugguauuuucucuguugagggcaaaagcugcaucaauaggugcuuuuauguggaguugauaaggggaagggaacaggaaacuagagucuuguggaccucaaacaguauuguuguguuuuguggcaccucagguaccuauggaacaggcucauggccugauggagcggacaucaaucucaugccuauauaa

SEQ ID NO: 52637 - RNA, 1410 nt, Artificial Sequence
  neuraminidase__InfluenzaA__AFH00739
augaauccaaaucaaaagauaauaacaauuggcucuguuucucucaccauugccacaauaugcuuccuuaugcaaauugccauucugguaacuacuguaacauugcauuucaagcaauaugagugcagcucccccccaaacaaccaaguaaugccgugugaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuugggcagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcaugguugcauguuugugucacugggcaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagauccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggagguugguccacaccuaacuccaaauugcagauaaauaggcaagucauaguugacagcgguaauagguccgguuauucugguauuuucucuguugagggcaaaagcugcaucaaucggugcuuuuauguggaguugauaaggggaaggggacaggaaacuagagucugguggaccucaaacaguauuguuguguuuuguggcaccucagguacauauggaacaggcucauggccugauggggcggacaucaaucucaugccuauauaa

SEQ ID NO: 52638 - RNA, 1410 nt, Artificial Sequence
  neuraminidase__InfluenzaA__AFH00750
augaauccaaaucaaaagauaauaacaauuggcucuguuucucucaccauugccacaauaugcuuccuuaugcaaauugccauccugguaacuacuguaacauugcauuucaagcaauaugagugcagcucccccccaaacaaccaaguaaugccgugcgaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuugggcagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcuuauacuaaaauacuauucauuaaagaggggaaaaucguucauauuagcccauugucaggaagugcucagcauguagaggagugcuccuguuauccucgauauccuggugucaggugugucugcagagacaacuggaaaggcuccaauaggcccaucguagauauaaaugugaaagauuauagcauuguuuccaguuaugugugcucagggcuuguuggagacacacccagaaaaaacgacagauccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggagguugguccacaccuaacuccaaauugcagauaaauaggcaagucauaguugaaagcgguaauagguccgguuauucugguauuuucucuguugagggcaaaagcugcaucaaucggugcuuuuauguggaguugauaaggggaagggaacaggaaacuagagucugguggaccucaaacaguauuguuguguuuuguggcaccucagguacauauggaacaggcucauggccugauggggcggacaucaaucucaugccuauauaa

SEQ ID NO: 52639 - RNA, 1410 nt, Artificial Sequence
  neuraminidase__InfluenzaA__AFH00761
augaauccaaaucaaaagauaauaacaauuggcucuguuucucucaccauugccacaauaugcuuccuuaugcaaauugccauccugguaacuacuguaacauugcauuucaagcaauaugagugcaacucccccccaaacaaccaaguaaugccgugugaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccggaauccuaacaaugagaaagggagucauggagugaaaggcugggccuuugacgauggagaugacguguggaugggaagaacgaucggcgaggaguuacgcucagguuaugaaaccuucaaagucauuggaggcugguccacaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacuaaagucugguggaccucaaacaguauuguuguguuuuguggcaccucagguacauauggaacaggcucauggccugauggggcggacaucaaucucaugccuauauaa

SEQ ID NO: 52640 - RNA, 1410 nt, Artificial Sequence
  neuraminidase__InfluenzaA__AFH00783
augaauccaaaucaaaagauaauaacuauuggcucuguuucucucacuauugccacaauaugcuuccuuaugcaaauugccauccugguaacuacuguaacauuacauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacggggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugauggaagugcuuccggaagagcugauacuaaaauacuauucauugaagaggggaaaaucguucauauuaguccauugucaggaagugcucagcaugucgaggagugcuccuguuauccucgauauucuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaguuucgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52641 - RNA, 1410 nt, Artificial Sequence
  neuraminidase__InfluenzaA__AFH00794
augaauccaaaucaaaagauaauaacgauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuugccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuugugugacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucagaaagagcugauacuaaaauacuauucauugaggaggggaaaaucguucauauuagccaauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccugaauccuaacaaugaagaagggggucauggagugaaaggcugggccuuugaugauggagaugacguguggaugggaagaacgaucagcgagaaguuacgcucagguuaugaaaccuucaaagucauugaaggcugguccaaaccuaacuccaaauugcagacaaauaggcaagucauaguugacagagguaacagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 52642 - RNA, 1410 nt, Artificial Sequence
  neuraminidase__InfluenzaA__AFH00805
augaauccaaaucaaaagauaauaacgauuggcucuguuucucucacuauugccacaauaugcuuccuuaugcaaauagccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauauagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaccgaacccuauugaugaaugaguuggguguuccauuucauuugggaaccaagcaaguaugcauagcaugguccagcucaaguugucacgauggaaaagcauggcugcauguuuguguaacugggcaugaugaaaaugcaacugcuagcuucauuuacgaugggagacuuguagauaguauugguucaugguccaaaaaaauccucaggacccaggagucggaaugcguuuguaucaauggaacuuguacaguaguaaugacugaugggagugcuucaggaagagcugauaccaaaauacuauucauugaggaggggaaaaucguucauacuagcaaauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccuggauccuaacaaugaagaagggggucauggagugaaaggcugggccuuugaugauggaaaugacguguggaugggaagaacgaucagcgagaagucacgcucagguuaugaaaccuucaaggucauugaaggcugguccaaaccuaacuccaaauugcagauaaauaggcaagucauaguugaaagagguaauagauccgguuauucugguauuuucucuguugaaggcaaaagcugcaucaaucggugcuuuuauguggaguugauaaggggaaggaaacaggaaacugaagucugguggaccucaaacaguauuguuguguucuguggcaccucagguacauauggaacaggcucauggccugauggggcggacaucaaucucaugccuauauaa

SEQ ID NO: 52643 - RNA, 1410 nt, Artificial Sequence
  neuraminidase__InfluenzaA__AFH00816
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcuaugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugauguguggaugggaagaacgaucaacgagacgucacguuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 52644 - RNA, 1410 nt, Artificial Sequence
  neuraminidase__InfluenzaA__AFH00827
augaauccaaaucaaaagauaauaacgauuggcucuguuucucucaccauuuccacaacaugcuucuucaugcaaauugccaucuugauaacuacuguaacauugcauuucaagcaauaugaauucaacucccccccaaacaaccaagugaugcugugugaaccaacaauaauagaaagaaacaugacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccugguguaagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggaaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuuuauaa

SEQ ID NO: 52645 - RNA, 1410 nt, Artificial Sequence; identical to SEQ ID NO: 46434
  neuraminidase__InfluenzaA__AFH01410

SEQ ID NO: 52646 - RNA, 1410 nt, Artificial Sequence
  neuraminidase__InfluenzaA__AFH34942
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaaaaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacguaauaggaccccuuaucggacuuuauugaugaaugaguuagguguuccuuuucaucuggggaccaagcaaguaugcauagcaugguccagcucaaguugucacgauggaaaagcauggcugcauguuuguauaacgggggaugauaaaaaugcaacugcuagcuucauuuacaaugggaagcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 52647 - RNA, 1410 nt, Artificial Sequence
  neuraminidase__InfluenzaA__AFH34956
augaauccaaaucaaaagauaauaacgauuggcucuguuucucucaccauuuccacaauaugcuucuucaugcaaauugccaucuugauaaccacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugguaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaaaugaagucuuguggaccucaaacaguauuguuguguuuuguggcaccucagguacauauggaacaggcucauggccugauggggcggaccucaaucucaugccuauauaa

SEQ ID NO: 52648 - RNA, 1410 nt, Artificial Sequence
  neuraminidase__InfluenzaA__AFH34963
augaauccaaaucaaaagauaauaacgauuggcucuguuucucucaccauuuccacaauaugcuucuucaugcaaauugccaucuugauaaccacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacauaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaaaugaagucuuguggaccucaaacaguauuguuguguuuuguggcaccucagguacauauggaacaggcucauggccugauggggcggaccucaaucucaugccuauauaa

SEQ ID NO: 52649 - RNA, 1410 nt, Artificial Sequence
  neuraminidase__InfluenzaA__AFH34970
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcuguaugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaaaugaagucuuguggaccucaaacaguauuguuguguuuuguggcaccucagguacauauggaacaggcucauggccugauggggcggaccucaaucucaugccuauauaa

SEQ ID NO: 52650 - RNA, 1410 nt, Artificial Sequence
  neuraminidase__InfluenzaA__AFH34977
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaauguggcauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuggguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaagagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaaggaaagaggaaacugaagucuuguggaccucaaacaguauuguuguguuuuguggcaccucagguacauauggaacaggcucauggccugauggggcggaccucaaucucaugccuauauaa

SEQ ID NO: 52651 - RNA, 1410 nt, Artificial Sequence
  neuraminidase__InfluenzaA__AFH74468
augaauccaaaucaaaagauaauaacgauuggcucuguuucucucaccauuuccacaauaugcuucuucaugcaaaccgccauccugauaacuacuguaacauugcauuucaagcaaugugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggagaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaaggugauaauggagugaaaggcugggccuuugaugauggaaaugacguguggaugggaagaacgaucagcgagaaaucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaauugauaaggggaaggaaagaggaaacugaagucuuguggaccucaaacaguauuguuguguuuuguggcaccucagguacauauggaacaggcucauggccugauggggcggacaucaaucucaugccuauauaa

SEQ ID NO: 52652 - RNA, 1410 nt, Artificial Sequence; identical to SEQ ID NO: 52355
  neuraminidase__InfluenzaA__AFH74469

SEQ ID NO: 52653 - RNA, 1410 nt, Artificial Sequence; identical to SEQ ID NO: 52135
  neuraminidase__InfluenzaA__AFH74480

SEQ ID NO: 52654 - RNA, 1410 nt, Artificial Sequence; identical to SEQ ID NO: 52136
  neuraminidase__InfluenzaA__AFH74491

SEQ ID NO: 52655 - RNA, 1410 nt, Artificial Sequence
  neuraminidase__InfluenzaA__AFH74502
augaauccaaaucaaaagauaauaacgauuggcucuguuucucucaccauuuccacaauaugcuucuucaugcaaaccgccauccugauaacuacuguaacauugcauuucaagcaaugugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacucuauugaugaaugaguuagguguuccuuuucaucuggggaccaagcaagugugcauagcaugguccagcucaaguugucaugauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucagggaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaaggugguaauggagugaaaggcugggccuuugaugauggaaaugacguguggaugggaagaacgaucagcgagaaaucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaauugauaaggggaaggaaagaggaaacugaagucuuguggaccucaaacaguauuguuguguuuuguggcaccucagguacauauggaacaggcucauggccugauggggcggacaucaaucucaugccuauauaa

SEQ ID NO: 52656 - RNA, 1410 nt, Artificial Sequence
  neuraminidase__InfluenzaA__AFH74513
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaacaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggagggaaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuguauaa

SEQ ID NO: 52657 - RNA, 1410 nt, Artificial Sequence
  neuraminidase__InfluenzaA__AFH74524
augaauccaaaccaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcucuuggacaaggaacaacaauaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacuuugucaggaagugcucagcaugucgaggagugcuccugcuauccucgauauccuggugucagaugcgucugcagagacaacuggaaaggcuccaauaggcccaucguagauauaaacaugaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucuggcauuuucucuguugaaggcaaaagcugcaucaaucggugcuuuuauguggaguugauaaggggaagaaaagaggaaacugaaguuuuguggaccucaaacaguguuguuguguuuuguggcaccucagguacauauggaacaggcucauggccugauggggcggacaucaaucucaugccuauauaa

SEQ ID NO: 52658 - RNA, 1410 nt, Artificial Sequence; identical to SEQ ID NO: 51413
  neuraminidase__InfluenzaA__AFH74535

SEQ ID NO: 52659 - RNA, 1410 nt, Artificial Sequence; identical to SEQ ID NO: 52139
  neuraminidase__InfluenzaA__AFH74546

SEQ ID NO: 52660 - RNA, 1410 nt, Artificial Sequence; identical to SEQ ID NO: 52139
  neuraminidase__InfluenzaA__AFH74557

SEQ ID NO: 52661 - RNA, 1410 nt, Artificial Sequence; identical to SEQ ID NO: 52139
  neuraminidase__InfluenzaA__AFH74568

SEQ ID NO: 52662 - RNA, 1410 nt, Artificial Sequence; identical to SEQ ID NO: 52142
  neuraminidase__InfluenzaA__AFH74579

SEQ ID NO: 52663 - RNA, 1410 nt, Artificial Sequence
  neuraminidase__InfluenzaA__AFH74590
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggagggaaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaacugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugucuguauaa

SEQ ID NO: 52664 - RNA, 1410 nt, Artificial Sequence; identical to SEQ ID NO: 52143
  neuraminidase__InfluenzaA__AFH74601

SEQ ID NO: 52665 - RNA, 1410 nt, Artificial Sequence
  neuraminidase__InfluenzaA__AFH74612
augaauccaaaucaaaagauaauaacgauuggcucuguuucucucaccauuuccacaauaugcuucuucaugcaaaccgccauccugauaacuacuguaacauugcauuucaagcaaugugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaagcaacgugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaaaucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaaggaaagaggaaacugaagucuuguggaccucaaacaguauuguuguguuuuguggcaccucagguacauauggaacaggcucauggccugauggggcggacaucaaucucaugccuauauaa

SEQ ID NO: 52666 - RNA, 1410 nt, Artificial Sequence
  neuraminidase__InfluenzaA__AFH74623
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggagggaaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggauggguagaacgaucagcgagaagucacgcuuaggguaugaaaccuucaaagucauugaaggcugguccaacccuaaguccaaacugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuguauaa

SEQ ID NO: 52667 - RNA, 1410 nt, Artificial Sequence; identical to SEQ ID NO: 52139
  neuraminidase__InfluenzaA__AFH74634

SEQ ID NO: 52668 - RNA, 1410 nt, Artificial Sequence; identical to SEQ ID NO: 52146
  neuraminidase__InfluenzaA__AFH74645

SEQ ID NO: 52669 - RNA, 1410 nt, Artificial Sequence; identical to SEQ ID NO: 52146
  neuraminidase__InfluenzaA__AFH74656

SEQ ID NO: 52670 - RNA, 1410 nt, Artificial Sequence; identical to SEQ ID NO: 52146
  neuraminidase__InfluenzaA__AFH74667

SEQ ID NO: 52671 - RNA, 1410 nt, Artificial Sequence; identical to SEQ ID NO: 52146
  neuraminidase__InfluenzaA__AFH74678

SEQ ID NO: 52672 - RNA, 1410 nt, Artificial Sequence; identical to SEQ ID NO: 51413
  neuraminidase__InfluenzaA__AFH74689

SEQ ID NO: 52673 - RNA, 1410 nt, Artificial Sequence; identical to SEQ ID NO: 51413
  neuraminidase__InfluenzaA__AFH74700

SEQ ID NO: 52674 - RNA, 1410 nt, Artificial Sequence
  neuraminidase__InfluenzaA__AFH74711
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggagggaaaaaucguucauacuagcacauugucaggaagugcucagcaugucgaggagugcuccugcuauccucgauauccuugugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacagaagucuuguggaccucaaacaguauuguuguguuuuguggcaccucagguacauauggaacaggcucauggccugauggggcggacaucaaucucaugccuguauaa

SEQ ID NO: 52675 - RNA, 1410 nt, Artificial Sequence; identical to SEQ ID NO: 52139
  neuraminidase__InfluenzaA__AFH74722

SEQ ID NO: 52676 - RNA, 1410 nt, Artificial Sequence; identical to SEQ ID NO: 52154
  neuraminidase__InfluenzaA__AFH74733

SEQ ID NO: 52677 - RNA, 1410 nt, Artificial Sequence
  neuraminidase__InfluenzaA__AFH74744
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggagggaaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaauuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuguauaa

SEQ ID NO: 52678 - RNA, 1410 nt, Artificial Sequence; identical to SEQ ID NO: 52155
  neuraminidase__InfluenzaA__AFH74755

SEQ ID NO: 52679 - RNA, 1410 nt, Artificial Sequence; identical to SEQ ID NO: 52155
  neuraminidase__InfluenzaA__AFH74766

SEQ ID NO: 52680 - RNA, 1410 nt, Artificial Sequence; identical to SEQ ID NO: 52157
  neuraminidase__InfluenzaA__AFH74777

SEQ ID NO: 52681 - RNA, 1410 nt, Artificial Sequence; identical to SEQ ID NO: 51413
  neuraminidase__InfluenzaA__AFH74788

SEQ ID NO: 52682 - RNA, 1410 nt, Artificial Sequence
  neuraminidase__InfluenzaA__AFH74799
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgguccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggagggaaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuguauaa

SEQ ID NO: 52683 - RNA, 1410 nt, Artificial Sequence; identical to SEQ ID NO: 52159
  neuraminidase__InfluenzaA__AFH74810

SEQ ID NO: 52684 - RNA, 1410 nt, Artificial Sequence; identical to SEQ ID NO: 52159
  neuraminidase__InfluenzaA__AFH74821

SEQ ID NO: 52685 - RNA, 1410 nt, Artificial Sequence; identical to SEQ ID NO: 52159
  neuraminidase__InfluenzaA__AFH74832

SEQ ID NO: 52686 - RNA, 1410 nt, Artificial Sequence; identical to SEQ ID NO: 52159
  neuraminidase__InfluenzaA__AFH74843

SEQ ID NO: 52687 - RNA, 1410 nt, Artificial Sequence; identical to SEQ ID NO: 52139
  neuraminidase__InfluenzaA__AFH74854

SEQ ID NO: 52688 - RNA, 1410 nt, Artificial Sequence; identical to SEQ ID NO: 52139
  neuraminidase__InfluenzaA__AFH74865

SEQ ID NO: 52689 - RNA, 1410 nt, Artificial Sequence; identical to SEQ ID NO: 52139
  neuraminidase__InfluenzaA__AFH74876

SEQ ID NO: 52690 - RNA, 1410 nt, Artificial Sequence; identical to SEQ ID NO: 52139
  neuraminidase__InfluenzaA__AFH74887

SEQ ID NO: 52691 - RNA, 1410 nt, Artificial Sequence; identical to SEQ ID NO: 52139
  neuraminidase__InfluenzaA__AFH74898

SEQ ID NO: 52692 - RNA, 1410 nt, Artificial Sequence; identical to SEQ ID NO: 52139
  neuraminidase__InfluenzaA__AFH74909

SEQ ID NO: 52693 - RNA, 1410 nt, Artificial Sequence
  neuraminidase__InfluenzaA__AFH74920
augaauccaaaucaaaagauaauaacgauuggcucuguuucucucaccauuuccacaauaugcuucuucaugcaaaccgccauccugauaacuacuguaacauugcauuucaagcaaugugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacgcuaaacaacgugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaaggugaucauggagugaaaggcugggccuuugaugauggaaaugacguguggaugggaagaacgaucagcgagaaaucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaaggaaagaggaaacugaagucuuguggaccucaaacaguauuguuguguuuuguggcaccucagguacauauggaacaggcucauggccugauggggcggacaucaaucucaugccuauauaa

SEQ ID NO: 52694 - RNA, 1410 nt, Artificial Sequence; identical to SEQ ID NO: 49755
  neuraminidase__InfluenzaA__AFH74931

SEQ ID NO: 52695 - RNA, 1410 nt, Artificial Sequence; identical to SEQ ID NO: 49755
  neuraminidase__InfluenzaA__AFH74942

SEQ ID NO: 52696 - RNA, 1410 nt, Artificial Sequence; identical to SEQ ID NO: 52139
  neuraminidase__InfluenzaA__AFH74953

SEQ ID NO: 52697 - RNA, 1410 nt, Artificial Sequence
  neuraminidase__InfluenzaA__AFH74964
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggagggaaaaaucguucauacuagcauauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuguauaa

SEQ ID NO: 52698 - RNA, 1410 nt, Artificial Sequence; identical to SEQ ID NO: 52139
  neuraminidase__InfluenzaA__AFH75391

SEQ ID NO: 52699 - RNA, 1410 nt, Artificial Sequence; identical to SEQ ID NO: 50389
  neuraminidase__InfluenzaA__AFH97143

SEQ ID NO: 52700 - RNA, 1410 nt, Artificial Sequence
  neuraminidase__InfluenzaA__AFI56407
augaauccaaaccaaaagauaauaaccauugguucggucuguaugacaauuggaauggcuaacuuaauauuacaaauuggaaacauaaucucaauauggauuagucacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaaggggaauguguuugucauaagggaaccauucauaucaugcucccccuuggaaugcaggaccuucuucuugacucaaggggccuugcuaaaugacaaacauuccaauggaaccauuaaagacaggagcccauaucgaaccuuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauagcuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacaguggcacuguggguuggucuuggccagacggugcugaguugccauuuaccauugacaaguaa

SEQ ID NO: 52701 - RNA, 1410 nt, Artificial Sequence
  neuraminidase__InfluenzaA__AFJ05141
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucgaauaacacaguacgugauaggaccccuuaucggucuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacagugguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 52702 - RNA, 1410 nt, Artificial Sequence
  neuraminidase__InfluenzaA__AFJ05145
augaauccaaaucaaaagauaauaacgauuggcucuguuucucucaccauguccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaaccagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucgaauaacacaguacgugauaggaccccuuaucggacuuuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacagugguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauugucuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 52703 - RNA, 1410 nt, Artificial Sequence
  neuraminidase__InfluenzaA__AFJ05635
augaauccaaaccaaaagauaauaaccauugguucggucuguaugacaauuggaauggcuaacuuaauauuacaaauuggaaacauaaucucaauauggauuagccacucaauucaacuuaggaaucaaagucagauugaaacaugcaaucaaagcgucauuacuuaugaaaacaacacuuggguaaaucagacauauguuaacaucagcaauaccaacuuugcugcuggacagucagugguuuccaugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacccaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaauaauauauugagaacacaagaaucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauacagcgggaguuuuguucagcauccagaacuaacagggcuggauuguauaagaccuugcuucuggguugaacuaaucagaggacgacccaaagagaacacaaucuggacuagcgggagcagcauauccuuuugugguguaaacagugacacuguggguuggucuuggccagacggugcugaguugccauuuaccauugacaaguaa

SEQ ID NO: 52704 - RNA, 1410 nt, Artificial Sequence
  neuraminidase__InfluenzaA__AFJ11709
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucgaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaauuguucacacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguauggaugggaagaacaaucaacgagacgucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugcuuauauaa

SEQ ID NO: 52705 - RNA, 1410 nt, Artificial Sequence
  neuraminidase__InfluenzaA__AFJ11720
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccgacaauaauagaaagaaacauaacagagauaguguaucugaccaacaccaccauagagaaggaaauaugccccaaacuagcggaauacagaaauuggucaaaaccgcaaugugacauuacaggauuugcaccuuuuucuaaggacaauucaauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcaagcuucauuuacaaugggaggcuuauagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauaguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucaacgagacgucacgcuugggguaugaaaccuucaaagucauugaaggcugguccaacccuaaguccaaauugcagauaaauaggcaagucauaguugacaaagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcugaccucaaucucaugccuauauaa

SEQ ID NO: 52706 - RNA, 1410 nt, Artificial Sequence; identical to SEQ ID NO: 52290
  neuraminidase__InfluenzaA__AFJ11731

SEQ ID NO: 52707 - RNA, 1410 nt, Artificial Sequence
  neuraminidase__InfluenzaA__AFJ19845
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccgacaauaauagaaagaaacauaacagagauaguguaucugaccaacaccaccauagagaaggaaauaugccccaaacuagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcaagcuucauuuacaaugggaggcuuguagauaguguuguuucaugguccaaagaaauucucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcucuugcuauccucgauauccugaugucagaugugucugcagagacaacuggaaaggcuccaauaggcccaucguagauauaaacauaaaggaucauagcauaguuuccaguuauguguguucaggacuuguuggagacacacccagaaaaaacgacagcuccagcaguagccauuguuuggauccuaacaaugaagaagguggucauggggugaaaggcugggccuuugaugauggaaaugacguauggaugggaagaacaaucaacgagacgucacgcuugggguaugaaaccuucaaagucauugaaggcugguccaacccuaaguccaaauugcagauaaauaggcaagucauaguugacaaagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 52708 - RNA, 1410 nt, Artificial Sequence; identical to SEQ ID NO: 47242
  neuraminidase__InfluenzaA__AFJ44697

SEQ ID NO: 52709 - RNA, 1410 nt, Artificial Sequence; identical to SEQ ID NO: 51094
  neuraminidase__InfluenzaA__AFJ69989

SEQ ID NO: 52710 - RNA, 1410 nt, Artificial Sequence
  neuraminidase__InfluenzaA__AFJ69990
augaauccaaaucaaaagauaauaaccauugguucggucuguaugacaauuggaauggcuaacuuaauauuacaaauuggaaacauaaccucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucggauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucgagaaacgguuuugagaugauuugggauccgaacggauggacugggacagacaauaacuucucaauaaagcaagauaucauaggaauaaaugaguggucaggauauagcgggaguuuuguucagcauccagaacuaacagggcuggauuguauaagaccuugcuuuuggguugaacuaaucagagggcggcccaaagagaauacaaucuggacuagcgggagcagcauauccuuuugugguguaaacagugacacuguggguuggucuuggccagacggugcugaguugccauuuaccauugacaaguaa

SEQ ID NO: 52711 - RNA, 1410 nt, Artificial Sequence
  neuraminidase__InfluenzaA__AFJ69991
augaauccaaaccaaaagauaauaaccauugguucagucuguaugacaauuggaauggcuaacuuaauauuacaaauuggaaacauaaucucaauauggauuagccacucaauucaacuugggaaucaaagccagauugaaacaugcaaucaaagcgucauuacuuaugaaaacaacacuuggguaaaucaaacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaaucaagauuugagucauucugcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 52712 - RNA, 1410 nt, Artificial Sequence
  neuraminidase__InfluenzaA__AFJ69992
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuuacuaaaugacaaacauuccaauggaaccauuaaagacaggagcccauaucgaacccuaaugagcuguccuauuggugaaguucccucuccauacaacucaagauuugagucagucgcuuggucagccagugcuugucaugauggcaucaauuggcuaacaauuggaauuucuggcccaaacaauggagcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacguccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguugguuggucuuggccagacggugcugaguugccauuuaccauugacaaguaa

SEQ ID NO: 52713 - RNA, 1410 nt, Artificial Sequence
  neuraminidase__InfluenzaA__AFJ69993
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaaugacagcuccagcaguagccauuguuuggauccuaacaaugaagaagguggucauggagugaaaggcugggccuuugaugauggaaaugacguguggaugggaagaacgaucaacgagacgucacguuuaggguaugaaaccuucaaagucauugaaggcugguccaacccuaaguccaaauugcagauaaauaggcaagucauaguuggcagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcgaaccucaaucucaugccuauauaa
